United States Patent
Hill et al.

(10) Patent No.: US 12,358,978 B2
(45) Date of Patent: Jul. 15, 2025

(54) ANTI-IL-27 ANTIBODIES AND USES THEREOF

(71) Applicant: Surface Oncology, LLC, Redwood City, CA (US)

(72) Inventors: Jonathan Hill, Cambridge, MA (US); Scott Chappel, Cambridge, MA (US); Michael Gladstone, Cambridge, MA (US); Bianka Prinz, Lebanon, NH (US); Andrew Lake, Cambridge, MA (US); Christine Miller, Cambridge, MA (US); Kerry White, Cambridge, MA (US); Jing Hua, Cambridge, MA (US); Pamela M. Holland, Cambridge, MA (US); Matthew Rausch, Cambridge, MA (US); Devapregasan Moodley, Cambridge, MA (US); Gege Tan, Cambridge, MA (US)

(73) Assignee: SURFACE ONCOLOGY, LLC, Redwood City, CA (US)

( * ) Notice: Subject to any disclaimer, the term of this patent is extended or adjusted under 35 U.S.C. 154(b) by 1005 days.

(21) Appl. No.: 17/413,269

(22) PCT Filed: Sep. 25, 2019

(86) PCT No.: PCT/US2019/053036
§ 371 (c)(1),
(2) Date: Jun. 11, 2021

(87) PCT Pub. No.: WO2020/123011
PCT Pub. Date: Jun. 18, 2020

(65) Prior Publication Data
US 2022/0259299 A1 Aug. 18, 2022

Related U.S. Application Data

(60) Provisional application No. 62/779,341, filed on Dec. 13, 2018.

(51) Int. Cl.
| | |
|---|---|
| C07K 16/24 | (2006.01) |
| A61K 39/00 | (2006.01) |
| A61P 35/00 | (2006.01) |
| A61P 37/04 | (2006.01) |
| C07K 16/28 | (2006.01) |
| G01N 33/574 | (2006.01) |

(52) U.S. Cl.
CPC ............ *C07K 16/244* (2013.01); *A61P 35/00* (2018.01); *A61P 37/04* (2018.01); *C07K 16/24* (2013.01); *C07K 16/2803* (2013.01); *C07K 16/2827* (2013.01); *C07K 16/2851* (2013.01); *G01N 33/574* (2013.01); *A61K 2039/505* (2013.01); *C07K 2317/24* (2013.01); *C07K 2317/33* (2013.01); *C07K 2317/34* (2013.01); *C07K 2317/565* (2013.01); *C07K 2317/76* (2013.01); *C07K 2317/92* (2013.01); *G01N 2333/54* (2013.01)

(58) Field of Classification Search
None
See application file for complete search history.

(56) References Cited

U.S. PATENT DOCUMENTS

| | | | |
|---|---|---|---|
| 3,710,795 A | 1/1973 | Higuchi et al. |
| 3,773,919 A | 11/1973 | Boswell et al. |
| 4,676,980 A | 6/1987 | Segal et al. |
| 4,863,457 A | 9/1989 | Lee |
| 5,223,409 A | 6/1993 | Ladner et al. |
| 5,403,484 A | 4/1995 | Ladner et al. |
| 5,427,908 A | 6/1995 | Dower et al. |
| 5,501,856 A | 3/1996 | Ohtori et al. |
| 5,516,637 A | 5/1996 | Huang et al. |
| 5,571,698 A | 11/1996 | Ladner et al. |
| 5,580,717 A | 12/1996 | Dower et al. |
| 5,624,821 A | 4/1997 | Winter et al. |
| 5,648,260 A | 7/1997 | Winter et al. |
| 5,658,727 A | 8/1997 | Barbas et al. |
| 5,698,426 A | 12/1997 | Huse |
| 5,733,743 A | 3/1998 | Johnson et al. |
| 5,750,753 A | 5/1998 | Kimae et al. |
| 5,780,225 A | 7/1998 | Wigler et al. |
| 5,821,047 A | 10/1998 | Garrard et al. |

(Continued)

FOREIGN PATENT DOCUMENTS

| | | |
|---|---|---|
| CN | 112512571 A | 3/2021 |
| EP | 0036676 A1 | 9/1981 |

(Continued)

OTHER PUBLICATIONS

Hino, Ryosuke et al., "Tumor Cell Expression of Programmed Cell Death-1 Ligand 1 Is a Prognostic Factor for Malignant Melanoma", Cancer, Apr. 1, 2010, 116(7), 1757-1766.

(Continued)

*Primary Examiner* — Zachary S Skelding
*Assistant Examiner* — Brianna K Swartwout
(74) *Attorney, Agent, or Firm* — Rothwell, Figg, Ernst and Manbeck, P.C.

(57) ABSTRACT

The present disclosure relates to anti-IL-27 antibodies, and antigen-binding portions thereof. The disclosure also relates to methods for treating or ameliorating one or more symptoms of a disease, such as cancer, by administering the antibodies or antigen-binding portion thereof. The disclosure also relates to methods for detecting IL-27 in, for example, a subject or a sample.

17 Claims, 44 Drawing Sheets
Specification includes a Sequence Listing.

(56) References Cited

U.S. PATENT DOCUMENTS

| | | | |
|---|---|---|---|
| 5,969,108 | A | 10/1999 | McCafferty et al. |
| 6,005,079 | A | 12/1999 | Casterman et al. |
| 6,300,064 | B1 | 10/2001 | Knappik et al. |
| 6,933,368 | B2 | 8/2005 | Co et al. |
| 6,995,259 | B1 | 2/2006 | Vargeese et al. |
| 7,595,048 | B2 | 9/2009 | Honjo et al. |
| 7,943,743 | B2 | 5/2011 | Korman et al. |
| 8,008,449 | B2 | 8/2011 | Korman et al. |
| 8,354,509 | B2 | 1/2013 | Carven et al. |
| 8,728,474 | B2 | 5/2014 | Honjo et al. |
| 8,779,105 | B2 | 7/2014 | Korman et al. |
| 8,900,587 | B2 | 12/2014 | Carven et al. |
| 8,952,136 | B2 | 2/2015 | Carven et al. |
| 9,067,999 | B1 | 6/2015 | Honjo et al. |
| 9,073,994 | B2 | 7/2015 | Honjo et al. |
| 11,332,524 | B2 | 5/2022 | Hill et al. |
| 2005/0214296 | A1 | 9/2005 | Kastelein et al. |
| 2008/0124345 | A1 | 5/2008 | Rothe et al. |
| 2008/0241223 | A1 | 10/2008 | Nivaggioli et al. |
| 2012/0183548 | A1 | 7/2012 | Wong et al. |
| 2013/0189262 | A1 | 7/2013 | Wong et al. |

FOREIGN PATENT DOCUMENTS

| | | | | |
|---|---|---|---|---|
| EP | 0088046 | A2 | 9/1983 | |
| EP | 0133988 | A2 | 3/1985 | |
| EP | 0143949 | A1 | 6/1985 | |
| EP | 0058481 | A1 | 10/1986 | |
| EP | 0430539 | B1 | 6/1991 | |
| EP | 0488401 | A1 | 6/1992 | |
| EP | 1537878 | A1 | 6/2005 | |
| EP | 2161336 | A1 | 3/2010 | |
| EP | 2170959 | B1 | 10/2013 | |
| JP | 2007-523169 | A | 8/2007 | |
| WO | 9002809 | A1 | 3/1990 | |
| WO | 9110737 | A1 | 7/1991 | |
| WO | 9201047 | A1 | 1/1992 | |
| WO | 9218619 | A1 | 10/1992 | |
| WO | 9311236 | A1 | 6/1993 | |
| WO | 9315722 | A1 | 8/1993 | |
| WO | 9404678 | A1 | 3/1994 | |
| WO | 9420069 | A1 | 9/1994 | |
| WO | 9425591 | A1 | 11/1994 | |
| WO | 9429351 | A2 | 12/1994 | |
| WO | 9515982 | A2 | 6/1995 | |
| WO | 9520401 | A1 | 8/1995 | |
| WO | 9627011 | A1 | 9/1996 | |
| WO | 9951642 | A1 | 10/1999 | |
| WO | 2005079848 | A2 | 9/2005 | |
| WO | 2007024715 | A2 | 3/2007 | |
| WO | 2008024188 | A2 | 2/2008 | |
| WO | 2009036379 | A2 | 3/2009 | |
| WO | 2010027827 | A2 | 3/2010 | |
| WO | 2010077634 | A1 | 7/2010 | |
| WO | 2010105256 | A1 | 9/2010 | |
| WO | 2010118243 | A2 | 10/2010 | |
| WO | 2011066342 | A2 | 6/2011 | |
| WO | 2011133931 | A1 | 10/2011 | |
| WO | 2012009568 | A2 | 1/2012 | |
| WO | 2012097238 | A2 | 7/2012 | |
| WO | 2013079174 | A1 | 6/2013 | |
| WO | 2013173223 | A1 | 11/2013 | |
| WO | 2015103072 | A1 | 7/2015 | |
| WO | 2016106159 | A1 | 6/2016 | |
| WO | WO-2018075740 | A1 * | 4/2018 | ........... A61K 31/138 |
| WO | 2018098363 | A2 | 5/2018 | |
| WO | 2019183499 | A1 | 9/2019 | |

OTHER PUBLICATIONS

Hisada, Masayuki et al., "Potent Antitumor Activity of Interleukin-27", Cancer Research 64, 1152-1156, Feb. 1, 2004.

Holliger, Philipp et al., ""Diabodies": Small bivalent and bispecific antibody fragments", PNAS, vol. 90, pp. 6444-6448, Jul. 1993.

Hoogenboom, Hennie R., "Designing and optimizing library selection strategies for generating high-affinity antibodies", Trends in Biotechnology, Feb. 1997, vol. 15, 62-70.

Hou, Jinzhao et al., "Expression of Active Thrombopoietin and Identification of its Key Residues Responsible for Receptor Binding", Cytokine, vol. 10, No. 5, 1998: 319-330.

Houdebine, Louis-Marie, "Antibody manufacture in transgenic animals and comparisons with other systems", Current Opinion in Biotechnology 2002, 13:625-629.

Hudson, Peter J. et al., "High avidity scFv multimers; diabodies and triabodies", Journal of Immunologcal Methods 231 (1999) 177-189.

Inman, Brand A. et al., "LD-L1 (B7-H1) Expression by Urothelial Carcinoma of the Bladder and BCG-Induced Granulomata", Cancer, Apr. 15, 2007, vol. 109, No. 8, 1499-1505.

Ishida, Yasumasa et al., "Induced expression of PD-1, a novel member of the immunoglobulin gene superfamily, upon programmed cell death", The EMBO Journal, vol. 11 no. 11, 3887-3895, 1992.

Isner, Jeffrey M. et al., "Angiogenesis and vasculogenesis as therapeutic strategies for postnatal neovascularization", The Journal of Clinical Investigation, May 1999, vol. 103, No. 9, 1231-1236.

Iwai, Yoshiko et al., "Involvement of PD-L1 on tumor cells in the escape from host immune system and tumor immunotherapy by PD-L1 blockade", PNAS, vol. 99, No. 19, Sep. 17, 2002, 12293-12297.

Jankowski, Marek et al., "Interleukin-27: Biological Properties and Clinical Application", Archivum Immunologiae et Therapiae Experimentalis 58, 417-425 (2010).

Johnson, David A. et al., "3-O-Desacyl Monophosphoryl Lipid A Derivatives: Synthesis and Immunostimulant Activities", J. Med. Chem. 1999, 42, 4640-4649.

Kaszubska, Wiweka et al., "Expression, Purification, and Characterization of Human Recombinant Thrombopoietin in Chinese Hamster Ovary Cells", Protein Expression and Purification, 18, (2000), 213-220.

Kettleborough, Catherine A. et al., "Isolation of tumor cell-specific single-chain Fv from immunized mice using phage-antibody libraries and the re-construction of whole antibodies from these antibody fragments", Eur. J. Immunol. 1994, 24: 952-958.

Kieki, Michele C. et al., "Isolation of anti-T cell receptor scFv mutants by yeast surface display", Protein Engineering, vol. 10, No. 11, 1303-1310, 1997.

Kim, Semi et al., "Regulation of Angiogenesis in Vivo by Ligation of Integrin α5β1 with the Central Cell-Binding Domain of Fibronectin" American Journal of Pathology, vol. 156, No. 4, Apr. 2000, 1345-1362.

Kim, Semi et al., "Regulation of Integrin αvβ3-mediated Endothelial Cell Migration and Angiogenesis by Integrin α5β1and Protein Kinase A" The Journal of Biological Chemistry, vol. 275, No. 43, Oct. 2000, 33920-33928.

Kinstler, Olaf et al., "Mono-N-terminal poly(ethylene glycol)-protein conjugates", Advanced Drug Delivery Reviews 54 (2002) 477-485.

Kirkland, Theo N. et al., "Analysis of the Fine Specificity and Cross-Reactivity of Monoclonal Anti-Lipid A Antibodies", The Journal of Immunology, vol. 137, No. 11, 3614-3619, Dec. 1, 1986.

Kitano, Atsuko et al., "Tumour-infiltrating lymphocytes are correlated with higher expression levels of PD-1 and Pd-L1 in early breast cancer", ESMO Open 2017; 2:e000150, 8 pages.

Kleffel, Sonja et al., "Melanoma cell-intrinsic PD-1 receptor functions promote tumor growth", Cell. Sep. 10, 2015; 162(6) 1242-1256.

Klemm, Per et al., "Fimbrial surface display systems in bacteria: from vaccines to random libraries", Microbiology (2000), 146, 3025-3032.

Konishi, Jun et al., "B7-H1 Expression on Non-Small Cell Lung Cancer Cells and Its Relationship with Tumor-Infiltrating Lymphocytes and Their PD-1 Expression", Clinical Cancer Research, vol. 10, 5094-5100, 2004.

Kostelny, Sheri A. et al., "Formation of a Bispecific Antibody by the Use of Leucine Zippers", The Journal of Immunology, vol. 148, 1547-1553, No. 5, 1992.

(56) References Cited

OTHER PUBLICATIONS

Langer, Robert et al., "Biocompatibility of polymeric delivery systems for macromolecules", Journal of Biomedical Materials Research, vol. 15, 267-277 (1981).
Larousserie, Frederique et al., "Analysis of Interleukin-27 (EBI3/p28) Expression in Epstein-Barr Virus- and Human T-Cell Leukemia Virus Type 1-Associated Lymphomas", American Journal of Pathology, vol. 166, No. 4, Apr. 2005.
Lee, L. Stanford et al., "Prolonged Circulating Lives of Single-Chain Fv Proteins Conjugated with Polyethylene Glycol: A Comparison of Conjugation Chemistries and Compounds", Bioconjugate Chem. 1999, 10, 973-981.
Liu et al., (2008) Scan. J. Immunol. 68:22-299.
Lodmell, Donald L. et al., "DNA vaccination of mice against rabies virus: effects of the route of vaccination and the adjuvant monophosphoryl lipid A (Mpl)", Vaccine 18 (2000) 1059-1066.
Lonberg, Nils et al., "Antigen-specific human antibodies from mice comprising four distinct genetic modifications", Nature, vol. 368, 1994, 856-859.
Lonberg, Nils, "Human antibodies from transgenic animals", Nature Biotechnology, 23, 1117-1125 (2005).
Lusky, Monika et al., "Inhibition of SV40 replication in simian cells by specific pBR322 DNA sequences", Nature, 293, 79-81 (1981).
Merz, David C. et al., "Generating a phage display antibody library against an identified neuron", Journal of Neuroscience Methods, 62 (1995) 213-219.
Moldenhauer, G. et al., "Identity of HML-1 Antigen on Intestinal Intraepithelial T Cells and of B-ly7 Antigen on Hairy Cell Leukaemia", Scand. J. Immunol. 32, 77-82, 1990.
Morel, Guillemette A. et al., "Monoclonal Antibodies to Bovine Serum Albumin: Affinity and Specificity Determinations", Molecular Immunology, vol. 25, No. 1, pp. 7-15, 1988.
Motz, Greg T. et al., "Deciphering and Reversing Tumor Immune Suppression", Immunity, Jul. 25, 2013; 39(1): 61-73.
Mueller, John P. et al., "Humanized Porcine VCAM-Specific Monoclonal Antibodies with Chimeric lgG2/G4 Constant Regions Block Human Leukocyte Binding to Porcine Endothelial Cells", Molecular Immunology, vol. 34, No. 6, pp. 441-452, 1997.
Mulligan, R.C., et al., "Selection for animal cells that express the *Escherichia coli* gene coding for xanthine-guanine phosphoribosyltransferase", Proc. Natl. Acad. Sci., vol. 78, No. 4, 2072-2076, Apr. 1981.
Muyldermans, Serge et al., "Recognition of antigens by single-domain antibody fragments: the superfluous luxury of paired domains", Trends in Biochemical Sciences, vol. 26, No. 4, Apr. 2001, 230-235.
Nakanishi, Juro et al., "Overexpression of B7-H1 (PD-L1) significantly associates with tumor grade and postoperative prognosis in human urothelial cancers", Cancer Immunol Immunother (2007) 56:1173-1182.
Needleman, Saul B. et al., "A General Method Applicable to the Search for Similarities in the Amino Acid Sequence of Two Proteins", J. Mol. Biol. (1970) 48, 443-453.
Nuttall, S.D. et al., "Immunoglobulin VH Domains and Beyond: Design and Selection of Single-Domain Binding and Targeting Reagents", Current Pharmaceutical Biotechnology, 2000, 1, 253-263.
Ohigashi, Yuichiro et al., "Clinical Significance of Programmed Death-1 Ligand-1 and Programmed Death-1 Ligand-2 Expression in Human Esophageal Cancer", Clin Cancer Res 2005; 11(8), Apr. 15, 2005, 2947-2953.
Ohtsuka, Eiko et al., "An Alternative Approach to Deoxyoligonucleotides as Hybridization Probes by Insertion of Deoxyinosine at Ambiguous Codon Positions", The Journal of Biological Chemistry, vol. 260, No. 5, 1985, 2605-2608.
Paolino, Magdalena et al., "The Role of TAM Family Receptors in Immune Cell Function: Implications for Cancer Therapy", Cancers 2016, 8, 97; doi: 10.3390/cancers8100097, 22 pages.
Pavisic, Renata et al., "Recombinant human granulocyte colony stimulating factor pre-screening and screening of stabilizing carbohydrates and polyols", International Journal of Pharmaceutics 387 (2010) 110-119.
PCT International Search Report and Written Opinion from PCT/US2019/053036, mailed Feb. 14, 2020, 17 pages.
Pearson, William R. et al., "Improved tools for biological sequence comparison", PNAS, vol. 85, 2444-2448, Apr. 1988.
Pereboev, Alexander et al., "Phage Display of Adenovirus Type 5 Fiber Knob as a Tool for Specific Ligand Selection and Validation", Journal of Virology, Aug. 2001, vol. 75, No. 15, 7107-7113.
Altschul, Stephen F. et al., "Basic Local Alignment Search Tool", J. Mol. Biol. (1990)215, 403-410.
Altschul, Stephen F. et al., "Gapped BLAST and PSI-BLAST: a new generation of protein database search programs", Nucleic Acids Research, 1997, vol. 25, No. 17, 3389-3402.
Ames, Robert S. et al., "Conversion of murine Fabs isolated from a combinatorial phage display library to full length immunoglobulins", Journal of Immunological Methods, 184 (1995) 177-186.
Baldridge, Jory R. et al., "Monophosphoryl Lipd A (MPL) Formulations for the Next Generation of Vaccines", Methods 19, 103-107 (1999).
Batzer, Mark A. et al., "Enhanced evolutionary PCR using oligonucleotides with inosine at the 3'-terminus", Nucleic Acids Research, vol. 19, No. 18, p. 5081, 1991.
Berge, Stephen M. et al., "Pharmaceutical Salts", Journal of Pharmaceutical Sciences, Jan. 1977, vol. 66, No. 1, pp. 1-19.
Bieg, S. et al., "GAD65 and Insulin B Chain Peptide (9-23) are not Primary Autoantigens in the Type 1 Diabetes Syndrome of the BB Rat", Autoimmunity, vol. 31, 15-24, 1999.
Blank, Christian et al., "Contribution of the PD-L1/PD-1 pathway to T-cell exhaustion: an update on implications for chronic infections and tumor evasion", Cancer Immunol Immunother (2007) 56:739-745.
Blank, Christian et al., "Interaction of PD-L1 on tumor cells with PD-1 on tumor-specific T cells as a mechanisms of immune evasion: implications for tumor immunotherapy", Cancer Immunol Immunother (2005) 54: 307-314.
Boder, Eric T. et al., "Yeast Surface Display for Directed Evolution of Protein Expression, Affinity and Stability", Methods in Enzymology, vol. 328, 2000, 430-444.
Brennan, Maureen et al., "Preparation of Bispecific Antibodies by Chemical Recombination of Monoclonal Immunoglobulin G1 Fragments", Science, vol. 229: 81, (1985).
Brinkmann, Ulrich et al., "Phage display of disulfide-stabilized Fv fragments", Journal of Immunological Methods, vol. 182, issue 1, 1995, pp. 41-50.
Brown, Julia A. et al., "Blockade of Programmed Death-1 Ligands on Dendritic Cells Enhances T Cell Activation and Cytokine Production", The Journal of Immunology, 2003, 170, 1257-1266.
Burton, Dennis R. et al., "Human Antibodies from Combinatorial Libraries", Advances in Immunology, vol. 57, (1994), 191-280.
Burton, Dennis R. et al., "Human Antibody Effector Function", Advances in Immunology, vol. 51, (1992) 1-84.
Canfield, Stephen M. et al., "The Binding Affinity of Human IgG for its High Affinity Fc Receptor Is Determined by Multiple Amino Acids in the CH2 Domain and Is Modulated by the Hinge Region", J. Exp. Med. (1991), vol. 173, 1483-1491.
Caron, Philip C. et al., "Engineered Humanized Dimeric Forms of IgG Are More Effective Antibodies", J. Exp. Med., Oct. 1992, vol. 176, 1191-1195.
Cebolla, Angel et al., "Expression Vectors for the Use of Eukaryotic Luciferases as Bacterial Markers with Different Colors of Luminescence", Applied and Environment Microbiology, Feb. 1995, 660-668, vol. 61, No. 2.
Chasteen, L. et al., "Eliminating helper phage from phage display", Nucleic Acids Research, 2006, vol. 32, No. 21, e145.
Chen, Daniel S. et al., "Oncology Meets Immunology: The Cancer-Immunity Cycle", Immunity 39, Jul. 25, 2013, pp. 1-10.
Cheung, Ramsey C. et al., "Epitope-Specific Antibody Response to the Surface Antigen of Duck Hepatitis B Virus in Infected Ducks", Virology 176, 546-552 (1990).

(56) References Cited

OTHER PUBLICATIONS

Co, Man Sung et al., "Genetically Engineering Deglycosylation of the Variable Domain Increases the Affinity of an Anti-CD33 Monoclonal Antibody", Molecular Immunology, vol. 30, No. 15, pp. 1361-1367, 1993.
Cornelis, Pierre, "Expressing genes in different *Escherichia coli* compartments", Curr Opin Biotechnol 11:45-0454, 2000.
Deans, Robert J. et al., "Expression of an immunoglobulin heavy chain gene transfected into lymphocytes", PNAS, vol. 81, 1292-1296, Mar. 1984.
Devergne, Odile et al., "Expression of Epstein-Barr Virus-Induced Gene 3, an Interleukin-12 p40-Related Molecule, throughout Human Pregnancy", American Journal of Pathology, vol. 159, No. 5, Nov. 2001, 1763-1776.
Di Niro, Roberto et al., "Characterizing monoclonal antibody epitopes by filtered gene fragment phage display", Biochem. J. (2005) 388, 889-894.
Diakowski et al., "Concentration of Serum Interleukin-27 Increase in Patients with Lymph Node Metastatic Gastroesophageal Cancer", (2013) Adv. Clin. Exp. Med. 22(5): 683-691.
Dietrich, Celine et al., "A Soluble Form of IL-27Rx Is a Natural IL-27 Antagonist", The Journal of Immunology, 2014, 192:5382-5389.
Dong, Haidong et al., "B7-H1 pathway and its role in the evasion of tumor immunity", J Mol Med (2003) 81:281-287.
Dong, Haidong et al., "Tumor-associated B7-H1 promotes T-cell apoptosis: A potential mechanisms of immune evasion", Nature Medicine, vol. 8, No. 8, Aug. 2002, 793-800.
Duncan, Alexander R. et al., "The binding site for Clq on IgG", Nature, vol. 332, 1988, 738-740.
Engberg, J. et al., "Phage-display libraries of murine and human antibody Fab fragments", Methods Mol Biol. 1995, 51:355-376.
Eppstein, Deborah A. et al., "Biological activity of liposome-encapsulated murine interferon y is mediated by a cell membrane receptor", Proc. Natl. Acad. Sci., vol. 82, 3688-3692, Jun. 1985.
Estep, Patricia et al., "High throughput solution-based measurement of antibody-antigen affinity and epitope binning", mAbs, vol. 5, issue 2, 2013, 270-278.
Etz, Hildegard et al., "Bacterial Phage Receptors, Versatile Tools for Display of Polypeptides on the Cell Surface", Journal of Bacteriology, Dec. 2001, vol. 183, No. 23, 6924-6935.
Fabbi, Marina et al., "Dual Roles of IL-27 in Cancer Biology and Immunotherapy", Mediators of Inflammation, vol. 2017, Feb. 1, 2017, pp. 1-14.
Fergusson, Joannah R. et al., "CD161 Defines a Transcriptional and Functional Phenotype across Distinct Human T Cell Lineages", Cell Reports 9, 2014, 1075-1088.
Fursov, Natalie et al., "Development and Utilization of Activated STAT3 Detection Assays for Screening a Library of Secreted Proteins", ASSAY and Drug Development Technology, vol. 9, No. 4, 2011, 420-429.
Gao, Qiang et al., "Overexpression of PD-L1 Significantly Associates with Tumor Aggressiveness and Postoperative Recurrence in Human Hepatocellular Carcinoma", Clin Cancer Res 2009; 15(3) Feb. 1, 2009, 971-979.
Ghebeh, Hazem et al., "The B7-H1 (PD-L1) T Lymphocyte-Inhibitory Molecular Is Expressed in Breast Cancer Patients with Infiltrating Ductal Carcinoma: Correlation with Important High-Risk Prognostic Factors", Neoplasia, vol. 8, No. 3, Mar. 2006, pp. 190-198.
Grabherr, R. et al., "The Baculovirus Expression System as a Tool for Generating Diversity by Viral Surface Display", Combinatorial Chemistry & High Throughput Screening, 2001, 4, 185-192.
Gruber, Meegan et al., "Efficient Tumor Cell Lysis Mediated by a Bispecific Single Chain Antibody Expressed in *Escherichia coli*", Journal of Immunology, 1994, 152:5368-5374.
Gupta, Rajesh K. et al., "Adjuvants for human vaccines—current status, problems and future prospects", Vaccine, vol. 13, No. 14, 1263-1276, 1995.
Hamanishi, Junzo et al., "Programmed cell death 1 ligand 1 and tumor-infiltrating CD8 T lymphocytes are prognostic factors of human ovarian cancer", PNAS, vol. 104, No. 9, Feb. 27, 2007, 3360-3365.
Hanahan, Douglas et al., "Hallmarks of Cancer: The Next Generation", Cell 144, Mar. 4, 2011, 646-674.
Hanauske, Axel-R. et al., "Phase 1b Dose Escalation Study of Erlotinib in Combination with Infusional 5-Fluorouracil, Leucovorin, and Oxaliplatin in Patients with Advanced Solid Tumors", Clin Cancer Res 2007; 13(2) 523-531.
Hanes, Jozef et al., "Picomolar affinity antibodies from a fully synthetic naive library selected and evolved by ribosome display", Nature Biotechnology, vol. 18, Dec. 2000, 1287-1292.
Harding, Fiona A. et al., "Class Switching in Human Immunoglobulin Transgenic Mice", Annals New York Academy of Sciences, 764: 536-546, 1995.
Harlow, Ed et al., Antibodies, A Laboratory Manual, Cold Spring Harbor Laboratory, 1988, 61 pages.
Hetherington, Seth et al., "Phase I Dose Escalation Study to Evaluate the Safety and Pharmacokinetic Profile of Tefibazumab in Subjects with End-Stage Renal Disease Requiring Hemodialysis", Antimicrobial Agents and Chemotherapy, Oct. 2006, vol. 50, No. 10, p. 3499-3500.
Persic, Lidija et al., "An integrated vector system for the eukaryotic expression of antibodies or their fragments after selection from phage display libraries", Gene 187 (1997) 9-18.
Poljak, Roberto J. "Production and structure of diabodies", Structure Dec. 15, 1994, 2:1121-1123.
Pollock, Daniel P. et al., "Transgenic milk as a method for the production of recombinant antibodies", Journal of Immunological Methods 231 (1999) 147-157.
Riechmann, Lutz et al., "Single domain antibodies: comparison of camel VH and camelised human VH domains", Journal of Immunological Methods, 231 (1999) 25-38.
Roberts, M.J. et al., "Chemistry for peptide and protein PEGylation", Advanced Drug Delivery Reviews, vol. 54, issue 4, Jun. 17, 2002, 459-476.
Rogers, Buck E. et al., "Localization of Iodine-125-mIP-Des-Met14-Bombesin (7-13) NH2 in Ovarian Carcinoma Induced to Express the Gastrin Releasing Peptide Receptor by Adenoviral Vector-Mediated Gene Transfer", J. Nucl Med, 1997, 38(8): 1221-1229.
Rondon, Isaac J. et al., "Intracellular Antibodies (Intrabodies) for Gene Therapy of Infectious Diseases", Annu. Rev. Microbiol. 1997. 51:257-83.
Rossolini, Gian Maria et al., "Use of deoxyinosine-containing primers vs degenerate primers for polymerase chain reaction based on ambiguous sequence information", Molecular and Cellular Probes (1994) 8, 91-98.
Sambrook et al., "Molecular Cloning: A Laboratory Manual", Second Edition, 1989, 631 pages.
Sarver, Nava et al., "Transformation and replication in mouse cells of a bovine papillomavirus-pML2 plasmid vector that can be rescued in bacteria", PNAS, vol. 79, 7147-7151, Dec. 1982.
Schaffitzel, Christiane et al., "Ribosome display: an in vitro method for selection and evolution of antibodies from libraries", Journal of Immunological Methods 231 (1999) 119-135.
Schoonbroodt, Sonia et al., "Oligonucleotide-assisted cleavage and ligation: a novel directional DNA cloning technology to capture cDNAs. Application in the construction of a human immune antibody phage-display library", Nucleic Acids Research, 2005, vol. 33, No. 9, e81, 14 pages.
Shalaby, M. Refaat et al., "Development of Humanized Bispecific Antibodies Reactive with Cytotoxic Lymphocytes and Tumor Cells Overexpressing the HER2 Protooncogene", J. Exp. Med., vol. 175, Jan. 1992, 217-225.
Shi, Lei et al., "De Novo Selection of High-Affinity Antibodies from Synthetic Fab Libraries Displayed on Phage as pIX Fusion Proteins", J. Mol. Biol. (2010) 397, 385-396.
Shimauchi, Takatoshi et al., "Augmented expression of programmed death-1 in both neoplastic and non-neoplastic CD4 T-cells in adult T-cell leukemia/lymphoma", Int. J. Cancer: 121, 2585-2590 (2007).

(56) References Cited

OTHER PUBLICATIONS

Shimizu, Motomu et al., "Antianbiogenic and Antitumor Activities of IL-27", The Journal of Immunology (2006) 176 (12): 7317-7324.
Shiraishi, Miyuki et al., "Short-step chemical synthesis of DNA by use of MMTrS group for protection of 5'-hydroxyl group", Nucleic Acids Symposium Series No. 51, 2007, 129-130.
Shopes, Bob, "A Genetically Engineered Human IgG Mutant With Enhanced Cytolytic Activity", The Journal of Immunology, vol. 148, No. 9, 1992, 2918-2922.
Sidman, Kenneth R. et al., "Controlled Release of Macromolecules and Pharmaceuticals from Synthetic Polypeptides Based on Glutamic Acid", Biopolymers, vol. 22, 547-556 (1983).
Siegel, Robert W. et al., "High efficiency recovery and epitope-specific sorting of an scFv yeast display library", Journal of Immunological Methods 286 (2004) 141-153.
Smith, Temple F. et al., "Comparison of Biosequences", Advances in Applied Mathematics 2, 482-489 (1981).
Songsivilai, S. et al., "Bispecific antibody: a tool for diagnosis and treatment of disease", Clin. exp. Immunol. (1990) 79, 315-321.
Southern, P.J. et al., "Transformation of mammalian cells to antibiotic resistance with a bacterial gene under control of the SV40 early region promoter", J. Mol App Genet. 1982; 1(4): 327-341 [abstract].
Stahli, C. et al., "Distinction of Epitopes by Monoclonal Antibodies", Methods in Enzymology, vol. 92, 1983, 242-253.
Suresh, M.R. et al., "Bispecific Monoclonal Antibodies from Hybrid Hybridomas", Methods in Enzymology, vol. 1211: 210, 1986.
Takahashi, Tomono et al., "Ischemia- and cytokine-induced mobilization of bone marrow-derived endothelial progenitor cells for neovascularization", Nature Medicine, vol. 5, No. 4, Apr. 1999, 434-438.
Thompson, R. Houston et al., "Significance of B7-H1 Overexpression in Kidney Cancer", Clinical Genitourinary Cancer, vol. 5, No. 3, 206-211, 2006.
Tochizawa, Shiro et al., "A novel modification of a flow cytometric assay of phosphorylated STAT1 in whole blood lymphocytes for rapid detection of interferon-α signal in vivo", Journal of Immunological Methods, vol. 313, Jun. 30, 2006, pp. 29-37.
Todorovska, Aneta et al., "Design and application of diabodies, triabodies and tetrabodies for cancer targeting", Journal of Immunological Methods 248 (2001) 47-66.
Tutt, Alison et al., "Trispecific F(ab')3 Derivatives That Use Cooperative Signaling Via the TCR/CD3 Complex and CD2 to Activate and Redirect Resting Cytotoxic T Cells", The Journal of Immunology, vol. 147, 60-69, No. 1, Jul. 1, 1991.
Van Gurp, E. et al., "Phase 1 Dose-Escalation Study of CP-690 550 in Stable Renal Allograft Recipients: Preliminary Findings of Safety, Tolerability, Effects on Lymphocyte Subsets and Pharmacokinetics", American Journal of Transplantation 2008; 8: 1711-1718.
Van Kuik-Romeijn, Petra et al., "Expression of a functional mouse-human chimeric anti-CD19 antibody in the milk of transgenic mice", Transgenic Research 2000, 9:155-159.
Varner, Judith A. et al., "Inhibition of angiogenesis and tumor growth by murine 7E3, the parent antibody of c7E3 Fab (abciximab; ReoProTM)", Angiogenesis 3, 53-60 (1999).
Wigler, Michael et al., "Transformation of Mammalian Cells with Genes from Procaryotes and Eucaryotes", Cell, vol. 16, Apr. 1979, 777-785.
Wright, Ann et al., "Antibody variable region glycosylation: position effects on antigen binding and carbohydrate structure", The EMBO Journal, vol. 10, No. 10, pp. 2717-2723, 1991.
Wu, Chengbin et al., "Simultaneous targeting of multiple disease mediators by a dual-variable-domain immunoglobulin", Nature Biotechnology, vol. 25, No. 11, Nov. 2007, 1290-1297.
Xu, Fang et al., "IL-27 is Elevated in Acute Lung Injury and Mediates Inflammation", J Clin Immunol (2013) 33:1257-1268.
Xu, Yingda et al., "Addressing polyspecificity of antibodies selected from an in vitro yeast presentation system: a FACS-based, high-throughput selection and analytical tool", Protein Engineering, Design & Selection, vol. 26, No. 10, 2013, 663-670.
Yang, Wanhua et al., "LD-L1: PD-1 Interaction Contributes to the Functional Suppression of T-Cell Responses to Human Uveal Melanoma Cells in Vitro", Invest Ophthalmol Vis Sci. Jun. 2008; 49(6) 2518-2525.
Yeung, Yik A. et al., "Quantitative Screening of Yeast Surface-Displayed Polypeptide Libraries by Magnetic Bead Capture", Biotechnol. Prog. 2002, 18, 212-220.
Yoshida, Hiroki et al., "The Immunobiology of Interleukin-27", Annu. Rev. Immunol. 2015. 33:417-43.
Yoshimoto, Takayuki et al., "Potential clinical application of interleukin-27 as an antitumor agent", Cancer Science, vol. 106, No. 9, Aug. 6, 2015, pp. 1103-1110.
Zapata, Gerardo et al., "Engineering linear F(ab')2 fragments for efficient production in *Escherichia coli* and enhanced antiproliferative activity", Protein Engineering, vol. 8, No. 10, pp. 1057-1062, 1995.
Notice of Final Rejection issued in JP 2021-533517 dated Jan. 18, 2024 (7 pages).
Office Action issued in CN Patent Application No. 2019800828145 dated Nov. 29, 2023 and English translation (12 pages).
Liu, Hong and Rohowsky-Kochan, Christine, "Interleukin-27-mediated suppression of human Th17 cells is associated with activation of STAT1 and suppressor of cytokine signaling protein 1", Journal of Interferon & Cytokine Research, May 5, 2011, 31(5), 459-469. (12 pages).
Shibata, Sayaka et al., "IL-27 activates Th1-mediated responses in imiquimod-induced psoriasis-like skin lesions", The Journal of Investigative Dermatology, Sep. 6, 2012, 133(2), 479-488. (10 pages).
Horlad, Hasita et al., "An IL-27/Stat3 axis induces expression of programmed cell death 1 ligands (PD-L1/2) on infiltrating macrophages in lymphoma", Cancer Science, 2016, 107(11), 1696-1704. (9 pages).
Aiba, Yoshihiro and Nakamura, Minoru, "The role of TL1A and DR3 in autoimmune and inflammatory diseases", Mediators of Inflammation, Dec. 21, 2013, 2013(258164). (10 pages).

\* cited by examiner

| Antibody | Forte Bio Affinity (IgG KD Human IL-27 Monovalent Pseudo-avidity) | MSD Affinity |
|---|---|---|
| SRF405 | 2.32E-10 | 1.00E-10 |
| SRF411 | 1.60E-09 | 4.30E-10 |
| SRF410 | 1.90E-09 | 3.90E-10 |
| SRF557 | 2.82E-10 | NA |
| SRF536 | 4.61E-10 | 4.80E-11 |
| SRF416 | 1.95E-10 | 1.30E-10 |
| SRF543 | 2.12E-10 | 2.60E-11 |
| SRF414 | 2.63E-10 | 5.20E-10 |
| SRF382 | 5.94E-10 | 1.30E-12 |
| SRF529 | 3.93E-10 | 5.90E-12 |
| SRF381 | 3.02E-10 | 2.80E-12 |
| SRF384 | 2.50E-09 | 7.50E-12 |
| SRF386 | 4.05E-10 | 2.40E-12 |
| SRF388 | 1.75E-09 | 3.40E-12 |
| Ab7 | NA | NA |

FIG. 1

| Antibody | (i) Affinity hIL-27 (M) | Affinity mIL-27 (M) | (ii) WSX-1 competitive | (iii) Inhibition of pSTAT1 U937 | (iv) Inhibition of CD161 | (v) Inhibition of PD-L1 in CD4 T cells | (vi) Enhances PD-1-mediated cytokine secretion |
|---|---|---|---|---|---|---|---|
| Ab7 | 1.00E-09 | N.B. | Yes | Yes | Yes | Yes | Not tested |
| 8B11 | N/A | N.B. | Binds WSX-1 | Yes | Yes | Yes | Not tested |
| SRF557 | 2.20E-09 | N.B. | No | No | No | No | Not tested |
| SRF536 | 4.80E-11 | 8.05E-08 | Yes | Yes | Yes | Yes | No |
| SRF416 | 1.30E-10 | N.B. | Yes | Yes | Yes | Yes | Not tested |
| SRF543 | 2.60E-11 | 6.21E-08 | Yes | Yes | Yes | Yes | Not tested |
| SRF414 | 5.20E-10 | P.F. | Yes | Yes | No | Yes | Not tested |
| SRF529 | 5.90E-12 | 1.33E-09 | Yes | Yes | Yes | Yes | Yes |
| SRF381 | 2.80E-12 | 4.56E-10 | Yes | Yes | No | Yes | Yes |
| SRF388 | 1.30E-12 | 5.94E-10 | Yes | Yes | Yes | Yes | Not tested |
| SRF382 | 7.50E-12 | 2.50E-09 | Yes | Yes | Yes | Yes | Not tested |
| SRF384 | 2.40E-12 | 4.05E-10 | Yes | Yes | Yes | Yes | Not tested |
| SRF386 | 3.40E-12 | 1.75E-09 | No | Yes | Yes | No | Not tested |
| SRF410 | 3.90E-10 | 5.81E-09 | No | Yes | No | No | Not tested |
| SRF411 | 4.30E-10 | 5.46E-10 | No | Yes | No | No | Not tested |
| SRF405 | 1.00E-10 | 5.02E-09 | No | Yes | No | No | Not tested |
| SRF573 | 7.40E-10 | N.B. | No | No | Yes | Yes | Not tested |
| SRF605 | P.F. | P.F. | Yes | Yes | No | No | Not tested |
| SRF535 | 1.15E-08 | N.B. | Yes | Yes | No | No | Not tested |
| SRF538 | 8.93E-09 | 1.82E-07 | No | No | No | No | Not tested |
| SRF541 | 9.44E-08 | N.B. | No | No | No | No | Not tested |
| SRF583 | 1.98E-09 | N.B. | No | No | Yes | No | Not tested |

FIG. 9

| Property | | |
|---|---|---|
| (i) | binds to human IL-27 with an equilibrium dissociation constant (KD) of 15 nM or less; | N.B. = non-binder |
| (ii) | blocks binding of IL-27 to IL-27 receptor; | P.F. = poor fit |
| (iii) | inhibits or reduces STAT1 and/or STAT3 phosphorylation in a cell; | |
| (iv) | inhibits or reduces IL-27-mediated inhibition of CD161 expression in a cell; | |
| (v) | inhibits or reduces IL-27-mediated PD-L1 and/or TIM-3 expression in a cell; and | |
| (vi) | induces or enhances PD-1-mediated secretion of one or more cytokines from a cell. | |

FIG. 9 continued

| Name | VH FR1 | SEQ ID | VH CDR1 | SEQ ID | VH FR2 | SEQ ID | VH CDR2 | SEQ ID |
|---|---|---|---|---|---|---|---|---|
| SRF405 | QVQLVQSGAEVKKPGSSVKVSCKASG | 477 | GTFVGYAIS | 483 | WVRQAPGQGLEWMG | 499 | GIIPIFGIANYAQKFQG | 504 |
| SRF410 | QVQLVQSGAEVKKPGSSVKVSCKASG | 477 | GTFSAYAIS | 484 | WVRQAPGQGLEWMG | 499 | GIIPIFGTANYAQKFQG | 505 |
| SRF411 | QVQLVQSGAEVKKPGSSVKVSCKASG | 477 | GTFESYTIS | 485 | WVRQAPGQGLEWMG | 499 | GIAPIFGTAHYAQKFQG | 506 |
| SRF557 | QVQLVQSGAEVKKPGSSVKVSCKASG | 477 | GTFSSYAIS | 486 | WVRQAPGQGLEWMG | 499 | GIIPIFGTANYAQKFQG | 507 |
| SRF536 | QVQLQQWGAGLLKPSETLSLTCAVYG | 478 | GSFSEYYWA | 487 | WIRQPPGKGLEWIG | 500 | EIDEVGSTNYNPSLKS | 508 |
| SRF414 | QVQLQQWGAGLLKPSETLSLTCAVYG | 478 | GSFSRYYWS | 488 | WIRQPPGKGLEWIG | 500 | SIDYSGSTEYNPSLKS | 509 |
| SRF416 | QVQLQQWGAGLLKPSETLSLTCAVYG | 478 | GSFSGYYWS | 489 | WIRQPPGKGLEWIG | 500 | EIDVDGSTNYNPSLKS | 510 |
| SRF529 | EVQLVESGGGLVKPGGSLRLSCAASG | 479 | FTFSSYSMN | 490 | WVRQAPGKGLEWVS | 501 | SISSSSSYIYYADSVKG | 511 |
| SRF381 | EVQLVESGGGLVKPGGSLRLSCAASG | 479 | FTFSRSYGMN | 491 | WVRQAPGKGLEWVS | 501 | SISSSSSYIYYADSVKG | 511 |
| SRF382 | EVQLVESGGGLVKPGGSLRLSCAASG | 479 | FTFSRTGMN | 492 | WVRQAPGKGLEWVS | 501 | SISSSSSYIYYADSVKG | 511 |
| SRF384 | EVQLVESGGGLVKPGGSLRLSCAASG | 479 | FTFSRYGMN | 493 | WVRQAPGKGLEWVS | 501 | SISSSSAYILYADSVKG | 512 |
| SRF386 | EVQLVESGGGLVKPGGSLRLSCAASG | 479 | FTFASYGMN | 494 | WVRQAPGKGLEWVS | 501 | SISSSSSYIYYADSVKG | 511 |
| SRF388 | EVQLVESGGGLVKPGGSLRLSCAASG | 479 | FTFSRSYGMN | 495 | WVRQAPGKGLEWVS | 501 | GISSSGSYIYYADSVKG | 513 |
| SRF535 | EVQLVESGGGLVQPGGSLRLSCAASG | 480 | FTFSSYGMS | 496 | WVRQAPGKGLEWVS | 502 | NIKQDGSEKYYVDSVKG | 514 |
| SRF538 | QVQLVESGGGVVQPGRSLRLSCAASG | 481 | FTFSSYGMH | 497 | WVRQAPGKGLEWVA | 502 | VIWYDGSNKYYADSVKG | 515 |
| SRF543 | QVQLQQWGAGLLKPSETLSLTCAVYG | 482 | GSFSDYEWS | 498 | WIRQPPGKGLEWIG | 503 | EIDWSGITNYNPSLKS | 516 |

FIG. 10A

| Name | VH FR3 | SEQ ID | VHCDR3 | SEQ ID | VH FR4 | SEQ ID |
|---|---|---|---|---|---|---|
| SRF405 | RVTITADESTSTAYMELSSLRSEDTAVYYC | 517 | ARSYYSSRWHYYYMDV | 522 | WGKGTTVTVSS | 531 |
| SRF410 | RVTITADESTSTAYMELSSLRSEDTAVYYC | 517 | ARSYYSSRWHYYYMDV | 522 | WGKGTTVTVSS | 531 |
| SRF411 | RVTITADESTSTAYMELSSLRSEDTAVYYC | 517 | ARSYYSSRWHYYYMDV | 522 | WGKGTTVTVSS | 531 |
| SRF557 | RVTITADESTSTATMELSSLRSEDTAVYYC | 517 | ARLGGRGYADEGWYFDL | 523 | WGRGTLVTVSS | 532 |
| SRF536 | RVTISVDTSKNQFSLKLSSVTAADTAVYYC | 518 | ARLPMYYDSSDLPMDV | 524 | WGQGTTVTVSS | 533 |
| SRF414 | RVTISVDTSKNQFSLKLSSVTAADTAVYYC | 518 | ARDGVYYDSSDLGFDI | 525 | WGQGTMVTVSS | 534 |
| SRF416 | RVTISVDTSKNQFSLKLSSVTAADTAVYYC | 518 | ARDGYYYDTSPYDV | 526 | WGQGTMVTVSS | 534 |
| SRF529 | RFTISRDNAKNSLYLQMNSLRAEDTAVYYC | 519 | ARDGGRTSYTATAHNWFDP | 527 | WGQGTLVTVSS | 535 |
| SRF381 | RFTISRDNAKNSLYLQMNSLRAEDTAVYYC | 519 | ARDGGRTSYTATAHNWFDP | 527 | WGQGTLVTVSS | 535 |
| SRF382 | RFTISRDNAKNSLYLQMNSLRAEDTAVYYC | 519 | ARDGGRTSYTATAHNWFDP | 527 | WGQGTLVTVSS | 535 |
| SRF384 | RFTISRDNAKNSLYLQMNSLRAEDTAVYYC | 519 | ARDGGRTSYTATAHNWFDP | 527 | WGQGTLVTVSS | 535 |
| SRF386 | RFTISRDNAKNSLYLQMNSLRAEDTAVYYC | 519 | ARDGGRTSYTATAHNWFDP | 527 | WGQGTLVTVSS | 535 |
| SRF388 | RFTISRDNAKNSLYLQMNSLRAEDTAVYYC | 519 | ARDGGRTSYTATAHNWFDP | 527 | WGQGTLVTVSS | 535 |
| SRF535 | RFTISRDNAKNSLYLQMNSLRAEDTAVYYC | 519 | ARDAPWDIYDYMDV | 528 | WGKGTTVTVSS | 536 |
| SRF538 | RFTISRDNSKNTLYLQMNSLRAEDTAVYYC | 520 | ARGAPEYVDV | 529 | WGQGTMVTVSS | 537 |
| SRF543 | RVTISVDTSKNQFSLKLSSVTAADTAVYYC | 521 | ARLPMYYDSSVSTGSVDV | 530 | WGQGTMVTVSS | 537 |

FIG. 10A (Continued)

| Name | VL FR1 | SEQ ID | VL CDR1 | SEQ ID | VL FR2 | SEQ ID | V CDR2 | SEQ ID |
|---|---|---|---|---|---|---|---|---|
| SRF405 | DIQMTQSPSSVSASVGDRVTITC | 538 | RASQGISSWLA | 545 | WYQQKPGKAPKLLIY | 552 | AASNLQS | 559 |
| SRF410 | DIQMTQSPSSVSASVGDRVTITC | 538 | RASQGISSWLA | 545 | WYQQKPGKAPKLLIY | 552 | AASNLQS | 559 |
| SRF411 | DIQMTQSPSSVSASVGDRVTITC | 538 | RASQGISSWLA | 545 | WYQQKPGKAPKLLIY | 552 | AASNLQS | 559 |
| SRF557 | EIVLTQSPGTLSLSPGERATLSC | 539 | RASQSVSSSYLA | 546 | WYQQKPGQAPRLLIY | 553 | GASSRAT | 560 |
| SRF536 | DIQMTQSPSSLSASVGDRVTITC | 540 | QASQDISNYLN | 547 | WYQQKPGKAPKLLIY | 554 | DASNLAT | 561 |
| SRF414 | DIQMTQSPSSLSASVGDRVTITC | 540 | QASQDISNYLN | 547 | WYQQKPGKAPKLLIY | 554 | DASNLET | 562 |
| SRF416 | EIVLTQSPATLSLSPGERATLSC | 541 | RASQSVSSYLA | 548 | WYQQKPGQAPRLLIY | 555 | DASNRAT | 563 |
| SRF529 | DIVMTQSPDSLAVSLGERATINC | 542 | KSSQSVLFSSNNKNYLA | 549 | WYQQKPGQPPKLLIY | 556 | WASTRES | 564 |
| SRF381 | DIVMTQSPDSLAVSLGERATINC | 542 | KSSQSVLFSSNNKNYLA | 549 | WYQQKPGQPPKLLIY | 556 | WASTRES | 564 |
| SRF382 | DIVMTQSPDSLAVSLGERATINC | 542 | KSSQSVLFSSNNKNYLA | 549 | WYQQKPGQPPKLLIY | 556 | WASTRES | 564 |
| SRF384 | DIVMTQSPDSLAVSLGERATINC | 542 | KSSQSVLFSSNNKNYLA | 549 | WYQQKPGQPPKLLIY | 556 | WASTRES | 564 |
| SRF386 | DIVMTQSPDSLAVSLGERATINC | 542 | KSSQSVLFSSNNKNYLA | 549 | WYQQKPGQPPKLLIY | 556 | WASTRES | 564 |
| SRF388 | DIVMTQSPDSLAVSLGERATINC | 542 | KSSQSVLFSSNNKNYLA | 549 | WYQQKPGQPPKLLIY | 556 | WASTRES | 564 |
| SRF535 | DIQMTQSPSSLSASVGDRVTITC | 543 | RASQSISSYLN | 550 | WYQQKPGKAPKLLIY | 557 | AASSLQS | 565 |
| SRF538 | EIVLTQSPATLSLSPGERATLSC | 544 | RASQSVSSYLA | 551 | WYQQKPGQAPRLLIY | 558 | DSSNRAT | 566 |
| SRF543 | EIVLTQSPATLSLSPGERATLSC | 544 | RASQSVSSYLA | 551 | WYQQKPGQAPRLLIY | 558 | DSSNRAT | 566 |

FIG. 10A (Continued)

| Name | VL FR3 | SEQ ID | VL CDR3 | SEQ ID | VH FR4 | SEQ ID |
|---|---|---|---|---|---|---|
| SRF405 | GVPSRFSGSGSGTDFTLTISSLQPEDFATYYC | 567 | QQADDLPLT | 574 | FGGGTKVEIK | 583 |
| SRF410 | GVPSRFSGSGSGTDFTLTISSLQPEDFATYYC | 567 | QQADDLPLT | 574 | FGGGTKVEIK | 583 |
| SRF411 | GVPSRFSGSGSGTDFTLTISSLQPEDFATYYC | 567 | QQADDLPLT | 574 | FGGGTKVEIK | 583 |
| SRF557 | GIPDRFSGSGSGTDFTLTISRLEPEDFAVYYC | 568 | QQYGSPIT | 575 | FGGGTKVEIK | 583 |
| SRF536 | GVPSRFSGSGSGTDFTFTISSLQPEDIATYYC | 569 | QQYDTLPLT | 576 | FGGGTKVEIK | 583 |
| SRF414 | GVPSRFSGSGSGTDFTFTISSLQPEDIATYYC | 569 | QQYDDTLPLT | 577 | FGGGTKVEIK | 583 |
| SRF416 | GIPARFSGSGSGTDFTLTISSLEPEDFAVYYC | 570 | QQRDSFPLT | 578 | FGGGTKVEIK | 583 |
| SRF529 | GVPDRFSGSGSGTDFTLTISSLQAEDVAVYYC | 571 | QQHASAPPT | 579 | FGGGTKVEIK | 583 |
| SRF381 | GVPDRFSGSGSGTDFTLTISSLQAEDVAVYYC | 571 | QQHASAPPT | 579 | FGGGTKVEIK | 583 |
| SRF382 | GVPDRFSGSGSGTDFTLTISSLQAEDVAVYYC | 571 | QQHASAPPT | 579 | FGGGTKVEIK | 583 |
| SRF384 | GVPDRFSGSGSGTDFTLTISSLQAEDVAVYYC | 571 | QQHASAPPT | 579 | FGGGTKVEIK | 583 |
| SRF386 | GVPDRFSGSGSGTDFTLTISSLQAEDVAVYYC | 571 | QQHASAPPT | 579 | FGGGTKVEIK | 583 |
| SRF388 | GVPDRFSGSGSGTDFTLTISSLQAEDVAVYYC | 571 | QQHASAPPT | 579 | FGGGTKVEIK | 583 |
| SRF535 | GVPSRFSGSGSGTDFTLTISSLQPEDFATYYC | 572 | QQSYVPPWT | 580 | FGGGTKVEIK | 583 |
| SRF538 | GIPARFSGSGSGTDFTLTISSLEPEDFAVYYC | 573 | QQYSLYPT | 581 | FGGGTKVEIK | 583 |
| SRF543 | GIPARFSGSGSGTDFTLTISSLEPEDFAVYYC | 573 | QQDSDHPIT | 582 | FGGGTKVEIK | 583 |

FIG. 10A (Continued)

| JMGT annotation. Name | VH FR1 | SEQ ID | VH CDR1 | SEQ ID | VH FR2 | SEQ ID | VH CDR2 | SEQ ID |
|---|---|---|---|---|---|---|---|---|
| SRF405 | QVQLVQSGAEVKKPGSSVKVSCKAS | 584 | GGTFVGYA | 590 | ISWVRQAPGQGLEWMGG | 605 | IIPIFGIA | 614 |
| SRF410 | QVQLVQSGAEVKKPGSSVKVSCKAS | 584 | GGTFSAYA | 591 | ISWVRQAPGQGLEWMGG | 605 | IIPIFGTA | 615 |
| SRF411 | QVQLVQSGAEVKKPGSSVKVSCKAS | 584 | GGTFESYT | 592 | ISWVRQAPGQGLEWMGG | 605 | IAPIFGTA | 616 |
| SRF557 | QVQLVQSGAEVKKPGSSVKVSCKAS | 584 | GGTFSSYA | 593 | ISWVRQAPGQGLEWMGG | 605 | IIPIFGTA | 615 |
| SRF536 | QVQLQQWGAGLLKPSETLSLTCAVY | 585 | GGSFSEYY | 594 | WAWIRQPPGKGLEWIGE | 606 | IDEVGST | 617 |
| SRF414 | QVQLQQWGAGLLKPSETLSLTCAVY | 585 | GGSFSRYY | 595 | WSWIRQPPGKGLEWIGS | 607 | IDYSGST | 618 |
| SRF416 | QVQLQQWGAGLLKPSETLSLTCAVY | 585 | GGSFSGYY | 596 | WSWIRQPPGKGLEWIGE | 608 | IDVDGST | 619 |
| SRF529 | EVQLVESGGGLVKPGGSLRLSCAAS | 586 | GFTFSSYS | 597 | MNWVRQAPGKGLEWVSS | 609 | ISSSSYI | 620 |
| SRF381 | EVQLVESGGGLVKPGGSLRLSCAAS | 586 | GFTFRSYG | 598 | MNWVRQAPGKGLEWVSS | 609 | ISSSSSYI | 620 |
| SRF382 | EVQLVESGGGLVKPGGSLRLSCAAS | 586 | GFTFSRTG | 599 | MNWVRQAPGKGLEWVSS | 609 | ISSSSSYI | 620 |
| SRF384 | EVQLVESGGGLVKPGGSLRLSCAAS | 586 | GFTFSRYG | 600 | MNWVRQAPGKGLEWVSS | 609 | ISSSAYI | 621 |
| SRF386 | EVQLVESGGGLVKPGGSLRLSCAAS | 586 | GFTFASYG | 601 | MNWVRQAPGKGLEWVSS | 609 | ISSSSSYI | 620 |
| SRF388 | EVQLVESGGGLVKPGGSLRLSCAAS | 586 | GFTFRSYG | 602 | MNWVRQAPGKGLEWVSG | 610 | ISSSGSYI | 622 |
| SRF535 | EVQLVESGGGLVQPGGSLRLSCAAS | 587 | GFTFSSYG | 603 | MSWVRQAPGKGLEWVAN | 611 | IKQDGSEK | 623 |
| SRF538 | QVQLVESGGGVVQPGRSLRLSCAAS | 588 | GFTFSSYG | 603 | MHWVRQAPGKGLEWVAV | 612 | IWYDGSNK | 624 |
| SRF543 | QVQLQQWGAGLLKPSETLSLTCAVY | 589 | GGSFSDYE | 604 | WSWIRQPPGKGLEWIGE | 613 | IDWSGIT | 625 |

FIG. 10B

| IMGT annotation Name | VH FR3 | SEQ ID | VHCDR3 | SEQ ID | VH FR2 | SEQ ID |
|---|---|---|---|---|---|---|
| SRF405 | NYAQKFQGRVTITADESTSTAYMELSSLRSEDTAVYYC | 626 | ARSYYSSRWHYYYYMDV | 637 | WGKGTTVTVSS | 646 |
| SRF410 | NYAQKFQGRVTITADESTSTAYMELSSLRSEDTAVYYC | 626 | ARSYYSSRWHYYYYMDV | 637 | WGKGTTVTVSS | 646 |
| SRF411 | HYAQKFQGRVTITADESTSTAYMELSSLRSEDTAVYYC | 627 | ARSYYSSRWHYYYYMDV | 637 | WGKGTTVTVSS | 646 |
| SRF557 | NYAQKFQGRVTITADESTSTAYMELSSLRSEDTAVYYC | 628 | ARLGGRGYADEGWYFDL | 638 | WGRGTLVTVTSS | 647 |
| SRF536 | NYNPSLKSRVTISVDTSKNQFSLKLSSVTAADTAVYYC | 629 | ARLPMYYDSSDLPMDV | 639 | WGQGTTVTVSS | 648 |
| SRF414 | EYNPSLKSRVTISVDTSKNQFSLKLSSVTAADTAVYYC | 630 | ARDGVYYDSSDLGFDL | 640 | WGQGTMVTVSS | 649 |
| SRF416 | NYNPSLKSRVTISVDTSKNQFSLKLSSVTAADTAVYYC | 629 | ARDGYYYDTSPYDV | 641 | WGQGTMVTVSS | 649 |
| SRF529 | YYADSVKGRFTISRDNAKNSLYLQMNSLRAEDTAVYYC | 631 | ARDGGRTSYTATAHNWFDP | 642 | WGQGTLVTVSS | 650 |
| SRF381 | YYADSVKGRFTISRDNAKNSLYLQMNSLRAEDTAVYYC | 631 | ARDGGRTSYTATAHNWFDP | 642 | WGQGTLVTVSS | 650 |
| SRF382 | YYADSVKGRFTISRDNAKNSLYLQMNSLRAEDTAVYYC | 631 | ARDGGRTSYTATAHNWFDP | 642 | WGQGTLVTVSS | 650 |
| SRF384 | LYADSVKGRFTISRDNAKNSLYLQMNSLRAEDTAVYYC | 632 | ARDGGRTSYTATAHNWFDP | 642 | WGQGTLVTVSS | 650 |
| SRF386 | YYADSVKGRFTISRDNAKNSLYLQMNSLRAEDTAVYYC | 633 | ARDGGRTSYTATAHNWFDP | 642 | WGQGTLVTVSS | 650 |
| SRF388 | YYADSVKGRFTISRDNAKNSLYLQMNSLRAEDTAVYYC | 633 | ARDGGRTSYTATAHNWFDP | 642 | WGQGTLVTVSS | 650 |
| SRF535 | YYVDSVKGRFTISRDNAKNSLYLQMNSLRAEDTAVYYC | 634 | ARDAPWDIYDYYMDV | 643 | WGKGTTVTVSS | 651 |
| SRF538 | YYADSVKGRFTISRDNSKNTLYLQMNSLRAEDTAVYYC | 635 | ARGAPEYVDV | 644 | WGQGTMVTVSS | 652 |
| SRF543 | NYNPSLKSRVTISVDTSKNQFSLKLSSVTAADTAVYYC | 636 | ARLPMYYDSSVSTGSVDV | 645 | WGQGTMVTVSS | 652 |

FIG. 10B (Continued)

| IMGT annotation: Name | VL FR1 | SEQ ID | VL CDR1 | SEQ ID | VL FR2 | SEQ ID | VL CDR2 | SEQ ID |
|---|---|---|---|---|---|---|---|---|
| SRF405 | DIQMTQSPSSVSASVGDRVTITCRAS | 653 | QGISSW | 660 | LAWYQQKPGKAPKLLIY | 667 | AAS | 674 |
| SRF410 | DIQMTQSPSSVSASVGDRVTITCRAS | 653 | QGISSW | 660 | LAWYQQKPGKAPKLLIY | 667 | AAS | 674 |
| SRF411 | DIQMTQSPSSVSASVGDRVTITCRAS | 653 | QGISSW | 660 | LAWYQQKPGKAPKLLIY | 667 | AAS | 674 |
| SRF557 | EIVLTQSPGTLSLSPGERATLSCRAS | 654 | QSVSSSY | 661 | LAWYQQKPGQAPRLLIY | 668 | GAS | 675 |
| SRF536 | DIQMTQSPSSLSASVGDRVTITCQAS | 655 | QDISNY | 662 | LNWYQQKPGKAPKLLIY | 669 | DAS | 676 |
| SRF414 | DIQMTQSPSSLSASVGDRVTITCQAS | 655 | QDISNY | 662 | LAWYQQKPGKAPKLLIY | 669 | DAS | 676 |
| SRF416 | EIVLTQSPATLSLSPGERATLSCRA | 656 | SQSVSSY | 663 | LAWYQQKPGQAPRLLIY | 670 | DAS | 676 |
| SRF529 | DIVMTQSPDSLAVSLGERATINCKSS | 657 | QSVLFSSNNKNY | 664 | LAWYQQKPGQPPKLLIY | 671 | WAS | 677 |
| SRF381 | DIVMTQSPDSLAVSLGERATINCKSS | 657 | QSVLFSSNNKNY | 664 | LAWYQQKPGQPPKLLIY | 671 | WAS | 677 |
| SRF382 | DIVMTQSPDSLAVSLGERATINCKSS | 657 | QSVLFSSNNKNY | 664 | LAWYQQKPGQPPKLLIY | 671 | WAS | 677 |
| SRF384 | DIVMTQSPDSLAVSLGERATINCKSS | 657 | QSVLFSSNNKNY | 664 | LAWYQQKPGQPPKLLIY | 671 | WAS | 677 |
| SRF386 | DIVMTQSPDSLAVSLGERATINCKSS | 657 | QSVLFSSNNKNY | 664 | LAWYQQKPGQPPKLLIY | 671 | WAS | 677 |
| SRF388 | DIVMTQSPDSLAVSLGERATINCKSS | 657 | QSVLFSSNNKNY | 664 | LAWYQQKPGQPPKLLIY | 671 | WAS | 677 |
| SRF535 | DIQMTQSPSSLSASVGDRVTITCRAS | 658 | QSISSY | 665 | LNWYQQKPGKAPKLLIY | 672 | AAS | 678 |
| SRF538 | EIVLTQSPATLSLSPGERATLSCRAS | 659 | QSVSSY | 666 | LAWYQQKPGQAPRLLIY | 673 | DSS | 679 |
| SRF543 | EIVLTQSPATLSLSPGERATLSCRAS | 659 | QSVSSY | 666 | LAWYQQKPGQAPRLLIY | 673 | DSS | 679 |

FIG. 10B (Continued)

| IMGT annotation: Name | VL FR3 | SEQ ID | VL CDR3 | SEQ ID | VH FR4 | SEQ ID |
|---|---|---|---|---|---|---|
| SRF405 | NLQSGVPSRFSGSGSGTDFTLTISSLQPEDFATYYC | 680 | QQADDLPLT | 688 | FGGGTKVEIK | 697 |
| SRF410 | NLQSGVPSRFSGSGSGTDFTLTISSLQPEDFATYYC | 680 | QQADDLPLT | 688 | FGGGTKVEIK | 697 |
| SRF411 | NLQSGVPSRFSGSGSGTDFTLTISSLQPEDFATYYC | 680 | QQADDLPLT | 688 | FGGGTKVEIK | 697 |
| SRF557 | SRATGIPTDREFSGSGSGTDFTLTISRLEPEDIATYYC | 681 | QQYYGSPIT | 689 | FGGGTKVEIK | 697 |
| SRF536 | NLATGVPSRFSGSGSGTDFTFTISSLQPEDIATYYC | 682 | QQYDLPLT | 690 | FGGGTKVEIK | 697 |
| SRF414 | NLETGVPSRFSGSGSGTDFTLTISSLQPEDIATYYC | 683 | QQYDDTLPLT | 691 | FGGGTKVEIK | 697 |
| SRF416 | NRATGIPARFSGSGSGTDFTLTISSLEPEDFAVYYC | 684 | QQRDSFPLT | 692 | FGGGTKVEIK | 697 |
| SRF529 | TRESGVPDRFSGSGSGTDFTLTISSLQAEDVAVYYC | 685 | QQHASAPPT | 693 | FGGGTKVEIK | 697 |
| SRF381 | TRESGVPDRFSGSGSGTDFTLTISSLQAEDVAVYYC | 685 | QQHASAPPT | 693 | FGGGTKVEIK | 697 |
| SRF382 | TRESGVPDRFSGSGSGTDFTLTISSLQAEDVAVYYC | 685 | QQHASAPPT | 693 | FGGGTKVEIK | 697 |
| SRF384 | TRESGVPDRFSGSGSGTDFTLTISSLQAEDVAVYYC | 685 | QQHASAPPT | 693 | FGGGTKVEIK | 697 |
| SRF386 | TRESGVPDRFSGSGSGTDFTLTISSLQAEDVAVYYC | 685 | QQHASAPPT | 693 | FGGGTKVEIK | 697 |
| SRF388 | TRESGVPDRFSGSGSGTDFTLTISSLQAEDVAVYYC | 685 | QQHASAPPT | 693 | FGGGTKVEIK | 697 |
| SRF535 | SLQSGVPSRFSGSGSGTDFTLTISSLQPEDFATYYC | 686 | QQSYVPPWT | 694 | FGGGTKVEIK | 697 |
| SRF538 | NRATGIPARFSGSGSGTDFTLTISSLEPEDFAVYYC | 687 | QQYSLYPT | 695 | FGGGTKVEIK | 697 |
| SRF543 | NRATGIPARFSGSGSGTDFTLTISSLEPEDFAVYYC | 687 | QQDSDHPIT | 696 | FGGGTKVEIK | 697 |

FIG. 10B (Continued)

ANTI-IL-27 ANTIBODIES AND USES THEREOF

CROSS REFERENCE TO RELATED APPLICATIONS

This application claims the benefit of U.S. Provisional Application No. 62/779,341, filed Dec. 13, 2018, the entire contents of which are incorporated herein by reference.

FIELD

The present disclosure relates generally to compositions and methods for modulating IL-27 signaling. More particularly, the present disclosure relates to immunogenic compositions (e.g., antibodies, antibody fragments, and the like) that bind to IL-27 and modulate IL-27 signaling.

BACKGROUND

In recent years, an increasing body of evidence suggests that the immune system operates as a significant barrier to tumor formation and progression. The principle that naturally-occurring T cells with anti-tumor potential or activity exist in a patient with cancer has rationalized the development of immunotherapeutic approaches in oncology. Immune cells, such as T cells, macrophages, and natural killer cells, can exhibit anti-tumor activity and effectively control the occurrence and growth of malignant tumors. Tumor-specific or -associated antigens can induce immune cells to recognize and eliminate malignancies (Chen & Mellman, (2013) *Immunity* 39(1):1-10). In spite of the existence of tumor-specific immune responses, malignant tumors often evade or avoid immune attack through a variety of immunomodulatory mechanisms resulting in the failure to control tumor occurrence and progression (Motz & Coukos, (2013) *Immunity* 39(1):61-730). Indeed, an emerging hallmark of cancer is the exploitation of these immunomodulatory mechanisms and the disablement of anti-tumor immune responses, resulting in tumor evasion and escape from immunological killing (Hanahan and Weinberg (2011) *Cell* 144(5):646-674).

IL-27 is a heterodimeric cytokine, composed of two subunits (EBI3 and IL-27p28). IL-27 is structurally related to both the IL-12 and IL-6 cytokine families. IL-27 binds to and mediates signaling through a heterodimer receptor consisting of IL-27Rα (WSX1) and gp130 chains, which mediate signaling predominantly through STAT1 and STAT3. Initial reports characterized IL-27 as an immune-enhancing cytokine that supports CD4+ T cell proliferation, T helper (Th)1 cell differentiation, and IFN-γ production, often acting in concert with IL-12. Subsequent studies have shown that IL-27 displays complex immunomodulatory functions, resulting in either proinflammatory or anti-inflammatory effects depending on the biological context and experimental models being used. IL-27 may drive the expression of different immune-regulatory molecules in human cancer cells, which may support local derangement of the immune response in vivo (Fabbi et al., (2017) Mediators Inflamm 3958069. Published online 2017 Feb. 1. doi:10.1155/2017/3958069, and references contained therein).

Despite the significant advances being made in cancer treatment and management, there is still an ongoing need for new and effective therapies for treating and managing cancer.

SUMMARY OF THE DISCLOSURE

Disclosed herein are antibodies, or antigen binding portions thereof, that specifically bind to and antagonize human IL-27 (Interleukin 27) with high affinity and specificity. Nucleic acid molecules encoding the antibody molecules, expression vectors, host cells and methods for making the antibody molecules are also provided. Pharmaceutical compositions comprising the antibody molecules are also provided. The anti-IL-27 antibodies, or antigen binding portions thereof, disclosed herein can be used (alone or in combination with other therapeutic agents or procedures) to treat, prevent and/or diagnose disorders, including immune disorders and cancer. Thus, compositions and methods for treating and/or diagnosing various disorders, including cancer and immune disorders, using the anti-IL-27 antibody molecules are disclosed herein.

In one aspect, the disclosure provides an isolated monoclonal antibody, or antigen binding portion thereof, wherein the antibody or antigen binding portion thereof comprises heavy and light chain CDRs selected from the group consisting of:
  (i) heavy chain CDR1, CDR2 and CDR3 sequences set forth in SEQ ID NOs: 706, 707 and 708, respectively, and light chain CDR1, CDR2 and CDR3 sequences set forth in SEQ ID NOs: 714, 715 and 716, respectively;
  (ii) heavy chain CDR1, CDR2 and CDR3 sequences set forth in SEQ ID NOs: 728, 729 and 730, respectively, and light chain CDR1, CDR2 and CDR3 sequences set forth in SEQ ID NOs: 736, 737 and 738, respectively;
  (iii) heavy chain CDR1, CDR2 and CDR3 sequences set forth in SEQ ID NOs: 750, 751 and 752, respectively, and light chain CDR1, CDR2 and CDR3 sequences set forth in SEQ ID NOs: 758, 759 and 760, respectively; and
  (iv) heavy chain CDR1, CDR2 and CDR3 sequences set forth in SEQ ID NOs: 772, 773 and 774, respectively, and light chain CDR1, CDR2 and CDR3 sequences set forth in SEQ ID NOs: 780, 781 and 782, respectively.

In one aspect, the disclosure provides an isolated monoclonal antibody, or antigen binding portion thereof, wherein the antibody or antigen binding portion thereof comprises heavy and light chain CDRs selected from the group consisting of:
  (i) heavy chain CDR1, CDR2 and CDR3 sequences set forth in SEQ ID NOs: 709, 710 and 711, respectively, and light chain CDR1, CDR2 and CDR3 sequences set forth in SEQ ID NOs: 717, 718 and 719, respectively;
  (ii) heavy chain CDR1, CDR2 and CDR3 sequences set forth in SEQ ID NOs: 731, 732 and 733, respectively, and light chain CDR1, CDR2 and CDR3 sequences set forth in SEQ ID NOs: 739, 740 and 741, respectively;
  (iii) heavy chain CDR1, CDR2 and CDR3 sequences set forth in SEQ ID NOs: 753, 754 and 755, respectively, and light chain CDR1, CDR2 and CDR3 sequences set forth in SEQ ID NOs: 761, 762 and 763, respectively; and
  (iv) heavy chain CDR1, CDR2 and CDR3 sequences set forth in SEQ ID NOs: 775, 776 and 777, respectively, and light chain CDR1, CDR2 and CDR3 sequences set forth in SEQ ID NOs: 783, 784 and 785, respectively.

In one aspect, the disclosure provides an isolated monoclonal antibody, or antigen binding portion thereof, wherein the antibody or antigen binding portion thereof comprises heavy and light chain CDRs, wherein the heavy chain CDR1, CDR2 and CDR3 sequences are set forth in SEQ ID NOs: 706, 707 and 708, respectively, and the light chain CDR1, CDR2 and CDR3 sequences are set forth in SEQ ID NOs: 714, 715 and 716, respectively.

In one aspect, the disclosure provides an isolated monoclonal antibody, or antigen binding portion thereof, wherein the antibody or antigen binding portion thereof comprises heavy and light chain CDRs, wherein the heavy chain CDR1, CDR2 and CDR3 sequences are set forth in SEQ ID NOs: 728, 729 and 730, respectively, and the light chain CDR1, CDR2 and CDR3 sequences are set forth in SEQ ID NOs: 736, 737 and 738, respectively.

In one aspect, the disclosure provides an isolated monoclonal antibody, or antigen binding portion thereof, wherein the antibody or antigen binding portion thereof comprises heavy and light chain CDRs, wherein the heavy chain CDR1, CDR2 and CDR3 sequences are set forth in SEQ ID NOs: 750, 751 and 752, respectively, and the light chain CDR1, CDR2 and CDR3 sequences are set forth in SEQ ID NOs: 758, 759 and 760, respectively.

In one aspect, the disclosure provides an isolated monoclonal antibody, or antigen binding portion thereof, wherein the antibody or antigen binding portion thereof comprises heavy and light chain CDRs, wherein the heavy chain CDR1, CDR2 and CDR3 sequences are set forth in SEQ ID NOs: 772, 773 and 774, respectively, and the light chain CDR1, CDR2 and CDR3 sequences are set forth in SEQ ID NOs: 780, 781 and 782, respectively.

In one aspect, the disclosure provides an isolated monoclonal antibody, or antigen binding portion thereof, wherein the antibody or antigen binding portion thereof comprises heavy and light chain variable regions, wherein the heavy chain variable region comprises an amino acid sequence selected from the group consisting of SEQ ID NOs: 712, 734, 756 and 778; and wherein the light chain variable region comprises an amino acid sequence selected from the group consisting of SEQ ID NOs: 720, 742, 764 and 786.

In one aspect, the disclosure provides an isolated monoclonal antibody, or antigen binding portion thereof, wherein the antibody or antigen binding portion thereof comprises heavy and light chain variable regions comprising amino acid sequences selected from the group consisting of:
  (i) SEQ ID NO: 712 and 720, respectively;
  (ii) SEQ ID NO: 734 and 742, respectively;
  (iii) SEQ ID NO: 756 and 764, respectively; and
  (iv) SEQ ID NO: 71775 and 786, respectively.

In one aspect, the disclosure provides an isolated monoclonal antibody, or antigen binding portion thereof, wherein the antibody or antigen binding portion thereof comprises heavy and light chain variable regions, wherein the heavy chain variable region comprises an amino acid sequence which is at least 90% identical to the amino acid sequence selected from the group consisting of SEQ ID NOs: 712, 734, 756 and 778; and wherein the light chain variable region comprises an amino acid sequence which is at least 90% identical to the amino acid sequence selected from the group consisting of SEQ ID NOs: 720, 742, 764 and 786.

In one aspect, the disclosure provides an isolated monoclonal antibody, or antigen binding portion thereof, wherein the antibody or antigen binding portion thereof comprises heavy and light chain variable regions comprising amino acid sequences at least 90% identical to the amino acid sequences selected from the group consisting of:
  (i) SEQ ID NO: 712 and 720, respectively;
  (ii) SEQ ID NO: 734 and 742, respectively;
  (iii) SEQ ID NO: 756 and 764, respectively; and
  (iv) SEQ ID NO: 778 and 786, respectively.

In one aspect, the disclosure provides an isolated monoclonal antibody, or antigen binding portion thereof, wherein the antibody or antigen binding portion thereof comprises heavy and light chain variable regions comprising amino acid sequences set forth in SEQ ID NO: 712 and 720, respectively.

In one aspect, the disclosure provides an isolated monoclonal antibody, or antigen binding portion thereof, wherein the antibody or antigen binding portion thereof comprises heavy and light chain variable regions comprising amino acid sequences at least 90% identical to the amino acid sequences set forth in SEQ ID NO: 712 and 720, respectively.

In one aspect, the disclosure provides an isolated monoclonal antibody, or antigen binding portion thereof, wherein the antibody or antigen binding portion thereof comprises heavy and light chain variable regions comprising amino acid sequences set forth in SEQ ID NO: 734 and 742, respectively.

In one aspect, the disclosure provides an isolated monoclonal antibody, or antigen binding portion thereof, wherein the antibody or antigen binding portion thereof comprises heavy and light chain variable regions comprising amino acid sequences at least 90% identical to the amino acid sequences set forth in SEQ ID NO: 734 and 742, respectively.

In one aspect, the disclosure provides an isolated monoclonal antibody, or antigen binding portion thereof, wherein the antibody or antigen binding portion thereof comprises heavy and light chain variable regions comprising amino acid sequences set forth in SEQ ID NO: 756 and 764, respectively.

In one aspect, the disclosure provides an isolated monoclonal antibody, or antigen binding portion thereof, wherein the antibody or antigen binding portion thereof comprises heavy and light chain variable regions comprising amino acid sequences at least 90% identical to the amino acid sequences set forth in SEQ ID NO: 756 and 764, respectively.

In one aspect, the disclosure provides an isolated monoclonal antibody, or antigen binding portion thereof, wherein the antibody or antigen binding portion thereof comprises heavy and light chain variable regions comprising amino acid sequences set forth in SEQ ID NO: 778 and 786, respectively.

In one aspect, the disclosure provides an isolated monoclonal antibody, or antigen binding portion thereof, wherein the antibody or antigen binding portion thereof comprises heavy and light chain variable regions comprising amino acid sequences at least 90% identical to the amino acid sequences set forth in SEQ ID NO: 778 and 786, respectively.

In one aspect, the disclosure provides an isolated monoclonal antibody, or antigen binding portion thereof, wherein the antibody or antigen binding portion thereof comprises a heavy chain and a light chain, wherein the heavy chain comprises an amino acid sequence selected from the group consisting of SEQ ID NOs: 722, 744, 766 and 788; and wherein the light chain comprises an amino acid sequence selected from the group consisting of SEQ ID NOs: 724, 746, 768 and 790.

In one aspect, the disclosure provides an isolated monoclonal antibody, or antigen binding portion thereof, wherein the antibody or antigen binding portion thereof comprises a heavy and a light chain, wherein the heavy chain comprises an amino acid sequence which is at least 90% identical to the amino acid sequence selected from the group consisting of SEQ ID NOs: 722, 744, 766 and 788; and wherein the light chain comprises an amino acid sequence which is at least 90% identical to the amino acid sequence selected from the group consisting of SEQ ID NOs: 724, 746, 768 and 790.

In one aspect, the disclosure provides an isolated monoclonal antibody, or antigen binding portion thereof, wherein the antibody or antigen binding portion thereof comprises a heavy chain and a light chain, wherein the heavy chain comprises an amino acid sequence selected from the group consisting of SEQ ID NOs: 726, 748, 770 and 792; and wherein the light chain comprises an amino acid sequence selected from the group consisting of SEQ ID NOs: 724, 746, 768 and 790.

In one aspect, the disclosure provides an isolated monoclonal antibody, or antigen binding portion thereof, wherein the antibody or antigen binding portion thereof comprises a heavy and a light chain, wherein the heavy chain comprises an amino acid sequence which is at least 90% identical to the amino acid sequence selected from the group consisting of SEQ ID NOs: 726, 748, 770 and 792; and wherein the light chain comprises an amino acid sequence which is at least 90% identical to the amino acid sequence selected from the group consisting of SEQ ID NOs: 724, 746, 768 and 790.

In one aspect, the disclosure provides an isolated monoclonal antibody, or antigen binding portion thereof, wherein the antibody or antigen binding portion thereof comprises a heavy chain and a light chain comprising amino acid sequences selected from the group consisting of:
  (i) SEQ ID NO: 722 and 724, respectively;
  (ii) SEQ ID NO: 744 and 746, respectively;
  (iii) SEQ ID NO: 766 and 768, respectively; and
  (iv) SEQ ID NO: 788 and 790, respectively.

In one aspect, the disclosure provides an isolated monoclonal antibody, or antigen binding portion thereof, wherein the antibody or antigen binding portion thereof comprises a heavy chain and a light chain comprising amino acid sequences at least 90% identical to the amino acid sequences selected from the group consisting of:
  (i) SEQ ID NO: 722 and 724, respectively;
  (ii) SEQ ID NO: 744 and 746, respectively;
  (iii) SEQ ID NO: 766 and 768, respectively; and
  (iv) SEQ ID NO: 788 and 790, respectively.

In one aspect, the disclosure provides an isolated monoclonal antibody, or antigen binding portion thereof, wherein the antibody or antigen binding portion thereof comprises a heavy and a light chain comprising amino acid sequences selected from the group consisting of:
  (i) SEQ ID NO: 726 and 724, respectively;
  (ii) SEQ ID NO: 748 and 746, respectively;
  (iii) SEQ ID NO: 770 and 768, respectively; and
  (iv) SEQ ID NO: 792 and 790, respectively.

In one aspect, the disclosure provides an isolated monoclonal antibody, or antigen binding portion thereof, wherein the antibody or antigen binding portion thereof comprises a heavy and a light chain comprising amino acid sequences at least 90% identical to the amino acid sequences selected from the group consisting of:
  (i) SEQ ID NO: 726 and 724, respectively;
  (ii) SEQ ID NO: 748 and 746, respectively;
  (iii) SEQ ID NO: 770 and 768, respectively; and
  (iv) SEQ ID NO: 792 and 790, respectively.

In one aspect, the disclosure provides an isolated monoclonal antibody, or antigen binding portion thereof, wherein the antibody or antigen binding portion thereof comprises a heavy chain and a light chain comprising amino acid sequences set forth in SEQ ID NO: 722 and 724, respectively.

In one aspect, the disclosure provides an isolated monoclonal antibody, or antigen binding portion thereof, wherein the antibody or antigen binding portion thereof comprises a heavy chain and a light chain comprising amino acid sequences at least 90% identical to the amino acid sequences set forth in SEQ ID NO: 722 and 724, respectively.

In one aspect, the disclosure provides an isolated monoclonal antibody, or antigen binding portion thereof, wherein the antibody or antigen binding portion thereof comprises a heavy and a light chain comprising amino acid sequences set forth in SEQ ID NO: 744 and 746, respectively.

In one aspect, the disclosure provides an isolated monoclonal antibody, or antigen binding portion thereof, wherein the antibody or antigen binding portion thereof comprises a heavy chain and a light chain comprising amino acid sequences at least 90% identical to the amino acid sequences set forth in SEQ ID NO: 744 and 746, respectively.

In one aspect, the disclosure provides an isolated monoclonal antibody, or antigen binding portion thereof, wherein the antibody or antigen binding portion thereof comprises a heavy chain and a light chain comprising amino acid sequences set forth in SEQ ID NO: 766 and 768, respectively.

In one aspect, the disclosure provides an isolated monoclonal antibody, or antigen binding portion thereof, wherein the antibody or antigen binding portion thereof comprises a heavy chain and a light chain comprising amino acid sequences at least 90% identical to the amino acid sequences set forth in SEQ ID NO: 766 and 768, respectively.

In one aspect, the disclosure provides an isolated monoclonal antibody, or antigen binding portion thereof, wherein the antibody or antigen binding portion thereof comprises a heavy and a light chain comprising amino acid sequences set forth in SEQ ID NO: 788 and 790, respectively.

In one aspect, the disclosure provides an isolated monoclonal antibody, or antigen binding portion thereof, wherein the antibody or antigen binding portion thereof comprises a heavy chain and a light chain comprising amino acid sequences at least 90% identical to the amino acid sequences set forth in SEQ ID NO: 788 and 790, respectively.

In one aspect, the disclosure provides an isolated monoclonal antibody, or antigen binding portion thereof, wherein the antibody or antigen binding portion thereof comprises a heavy chain and a light chain comprising amino acid sequences set forth in SEQ ID NO: 726 and 724, respectively.

In one aspect, the disclosure provides an isolated monoclonal antibody, or antigen binding portion thereof, wherein the antibody or antigen binding portion thereof comprises a heavy chain and a light chain comprising amino acid sequences at least 90% identical to the amino acid sequences set forth in SEQ ID NO: 726 and 724, respectively.

In one aspect, the disclosure provides an isolated monoclonal antibody, or antigen binding portion thereof, wherein the antibody or antigen binding portion thereof comprises a heavy and a light chain comprising amino acid sequences set forth in SEQ ID NO: 748 and 746, respectively.

In one aspect, the disclosure provides an isolated monoclonal antibody, or antigen binding portion thereof, wherein the antibody or antigen binding portion thereof comprises a heavy chain and a light chain comprising amino acid sequences at least 90% identical to the amino acid sequences set forth in SEQ ID NO: 748 and 746, respectively.

In one aspect, the disclosure provides an isolated monoclonal antibody, or antigen binding portion thereof, wherein the antibody or antigen binding portion thereof comprises a heavy chain and a light chain comprising amino acid sequences set forth in SEQ ID NO: 770 and 768, respectively.

In one aspect, the disclosure provides an isolated monoclonal antibody, or antigen binding portion thereof, wherein the antibody or antigen binding portion thereof comprises a heavy chain and a light chain comprising amino acid sequences at least 90% identical to the amino acid sequences set forth in SEQ ID NO: 770 and 768, respectively.

In one aspect, the disclosure provides an isolated monoclonal antibody, or antigen binding portion thereof, wherein the antibody or antigen binding portion thereof comprises a heavy and a light chain comprising amino acid sequences set forth in SEQ ID NO: 792 and 790, respectively.

In one aspect, the disclosure provides an isolated monoclonal antibody, or antigen binding portion thereof, wherein the antibody or antigen binding portion thereof comprises a heavy chain and a light chain comprising amino acid sequences at least 90% identical to the amino acid sequences set forth in SEQ ID NO: 792 and 790, respectively.

In some embodiments, the disclosure provides a pharmaceutical composition comprising an isolated monoclonal antibody or antigen binding portion thereof, of the above aspects, and a pharmaceutically acceptable carrier.

In some embodiments, the disclosure provides a nucleic acid comprising a nucleotide sequence encoding the light chain, heavy chain, or both light and heavy chains of the isolated monoclonal antibody, or antigen binding portion thereof, of any one of the above aspects.

In some embodiments, the disclosure provides an expression vector comprising the above nucleic.

In some embodiments, the disclosure provides a cell transformed with the above expression vector.

In some embodiments, the disclosure provides that the above isolated monoclonal antibodies, or antigen binding fragments thereof, may specifically bind to human IL-27 and/or specifically antagonize human IL-27.

In some embodiments, the disclosure provides a method for producing a monoclonal antibody that specifically binds human IL-27, or an antigen binding portion thereof, the method comprising maintaining the above cell under conditions permitting expression of the monoclonal antibody or antigen binding portion thereof. In some embodiments, the method further comprises obtaining the monoclonal antibody or antigen binding portion thereof.

In some embodiments, the disclosure provides a method to inhibit or reduce STAT1 and/or STAT3 phosphorylation in a cell, the method comprising contacting the cell with any of the above isolated monoclonal antibodies, or antigen binding fragments, wherein the antibody, or antigen binding portion thereof, inhibits or reduces STAT1 and/or STAT3 phosphorylation in a cell.

In some embodiments, the disclosure provides a method to inhibit or reduce inhibition of CD161 expression in a cell, the method comprising contacting the cell with any of the above isolated monoclonal antibodies, or antigen binding fragments, wherein the antibody, or antigen binding portion thereof, inhibits or reduces inhibition of CD161 expression in a cell.

In some embodiments, the disclosure provides a method to inhibit or reduce PD-L1 and/or TIM-3 expression in a cell, the method comprising contacting the cell with any of the above isolated monoclonal antibodies, or antigen binding fragments, wherein the antibody, or antigen binding portion thereof, inhibits or PD-L1 and/or TIM-3 expression in a cell.

In some embodiments, the disclosure provides a method to induce or enhance secretion of one or more cytokines from a cell, the method comprising contacting the cell with any of the above isolated monoclonal antibodies, or antigen binding fragments, wherein the antibody, or antigen binding portion thereof, induces or enhances PD-1 mediated secretion of one or more cytokines from a cell.

In some embodiments, the disclosure provides a method of stimulating an immune response in a subject, the method comprising administering to the subject an effective amount of the any of the above isolated monoclonal antibodies, or antigen binding fragments, or the above pharmaceutical composition.

In some embodiments, the disclosure provides a method of treating a cancer in a subject, the method comprising administering to the subject an effective amount of any of the above isolated monoclonal antibodies, or antigen binding fragments, or the above pharmaceutical composition.

In some embodiments, the disclosure provides a method of stimulating an immune response, or treating a cancer in a subject, the method comprising administering to the subject an effective amount of any of the above isolated monoclonal antibodies, or antigen binding fragments, or the above pharmaceutical composition, wherein the antibody, or antigen binding portion thereof, or the pharmaceutical composition inhibits or reduces STAT1 and/or STAT3 phosphorylation in a cell, thereby stimulating the immune response, or treating the cancer.

In some embodiments, the disclosure provides a method of stimulating an immune response, or treating a cancer in a subject, the method comprising administering to the subject an effective amount of any of the above isolated monoclonal antibodies, or antigen binding fragments, or the above pharmaceutical composition, wherein the antibody, or antigen binding portion thereof, or the pharmaceutical composition inhibits or reduces inhibition of CD161 expression in a cell, thereby stimulating the immune response, or treating the cancer.

In some embodiments, the disclosure provides a method of stimulating an immune response, or treating a cancer in a subject, the method comprising administering to the subject an effective amount of any of the above isolated monoclonal antibodies, or antigen binding fragments, or the above pharmaceutical composition, wherein the antibody, or antigen binding portion thereof, or the pharmaceutical composition inhibits or reduces PD-L1 and/or TIM-3 expression on a cell, thereby stimulating the immune response, or treating the cancer.

In some embodiments, the disclosure provides a method of stimulating an immune response, or treating a cancer in a subject, the method comprising administering to the subject an effective amount of any of the above isolated monoclonal antibodies, or antigen binding fragments, or the above pharmaceutical compositions, wherein the antibody, or antigen binding portion thereof, or the pharmaceutical composition induces or enhances PD-1-mediated secretion of one or more cytokines from a cell, thereby stimulating the immune response, or treating the cancer.

In some embodiments, the cancer is chosen from lung cancer (e.g., non-small cell lung cancer), sarcoma, testicular cancer, ovarian cancer, pancreas cancer, breast cancer (e.g., triple-negative breast cancer), melanoma, head and neck cancer (e.g., squamous head and neck cancer), colorectal cancer, bladder cancer, endometrial cancer, prostate cancer, thyroid cancer, hepatocellular carcinoma, gastric cancer, brain cancer, lymphoma (e.g., DL-BCL), leukemia (e.g., AML) or renal cancer (e.g., renal cell carcinoma, e.g., renal clear cell carcinoma).

In some embodiments, the disclosure provides a method of enhancing one or more activities of an anti-PD-1 antibody (e.g., enhances PD-1-mediated cytokine secretion; enhances anti-PD-1 mediated TNFα secretion; enhances anti-PD-1 mediated IL-6 secretion from a cell exposed to anti-PD-1 antibodies), the method comprising exposing a cell to any of the above antibodies, or antigen binding portions thereof, concurrently with or sequentially to an anti-PD-1 antibody, thereby to enhance one or more activities of anti-PD1 antibodies.

In some embodiments, the disclosure provides a pharmaceutical composition comprising an anti-PD-1 antibody and any of the above antibodies, or antigen binding portions thereof, and a pharmaceutically acceptable carrier.

In some embodiments, the disclosure provides a kit comprising an anti-PD-1 antibody and any of the above antibodies, or antigen binding portions thereof, for concurrent or sequential administration, and instructions for its use.

In some embodiments, the disclosure provides that any of the above isolated monoclonal antibodies, or antigen binding portions thereof, is administered in combination with one or more additional therapeutic agents or procedure, wherein the second therapeutic agent or procedure is selected from the group consisting of: a chemotherapy, a targeted anti-cancer therapy, an oncolytic drug, a cytotoxic agent, an immune-based therapy, a cytokine, surgical procedure, a radiation procedure, an activator of a costimulatory molecule, an inhibitor of an inhibitory molecule, a vaccine, or a cellular immunotherapy, or a combination thereof.

In some embodiments, the disclosure provides that the one or more additional therapeutic agents is a PD-1 antagonist, a PD-L1 inhibitor, a TIM-3 inhibitor, a LAG-3 inhibitor, a TIGIT inhibitor, a CD112R inhibitor, a TAM inhibitor, a STING agonist, a 4-1BB agonist, a CTLA-4 inhibitor, a CD73 inhibitor, a CD39 inhibitor, an A2AR inhibitor, an IDO inhibitor, peg-IL-2, peg IL-10, a CD40 agonist, or a combination thereof.

In some embodiments, the disclosure provides that the one or more additional therapeutic agents is a PD-1 antagonist.

In some embodiments, the disclosure provides that the PD-1 antagonist is selected from the group consisting of: PDR001, nivolumab, pembrolizumab, pidilizumab, MEDI0680, REGN2810, TSR-042, PF-06801591, AMP-224, AB122, and JTX-4014.

In some embodiments, the disclosure provides that the PD-L1 inhibitor is selected from the group consisting of: FAZ053, Atezolizumab, Avelumab, Durvalumab, and BMS-936559.

In some embodiments, the disclosure provides that the one or more additional therapeutic agents is selected from the group consisting of sunitinib (Sutent®), Cabozantinib (Cabometyx®), Axitinib (Inlyta®), Lenvatinib (Lenvima®), Everolimus (Afinitor®), Bevacizumab (Avastin®), epacadostat, NKTR-214 (CD-122-biased agonist), tivozanib (Fotivda®), abexinostat, Ipilimumab (Yervoy®), tremelimumab, Pazopanib (Votrient®), Sorafenib (Nexavar®), Temsirolimus (Torisel®), Ramucirumab (Cyramza®), niraparib, savolitinib, vorolanib (X-82), Regorafenib (Stivargo®), Donafenib (multikinase inhibitor), Camrelizumab (SHR-1210), pexastimogene devacirepvec (JX-594), Ramucirumab (Cyramza®), apatinib (YN968D1), encapsulated doxorubicin (Thermodox®), Tivantinib (ARQ197), ADI-PEG 20, binimetinib, apatinib mesylate, nintedanib, lirilumab, Nivolumab (Opdivo®), Pembrolizumab (Keytruda®), Atezolizumab (Tecentric®), Avelumab (Bavencio®), Durvalumab (Imfimzi®), cemiplimab-rwlc (Libtayo®), tislelizumab, and spartalizumab.

In some embodiments, the disclosure provides that the one or more additional therapeutic agents is a TIM-3 inhibitor, optionally wherein the TIM-3 inhibitor is MGB453 or TSR-022.

In some embodiments, the disclosure provides that the one or more additional therapeutic agents is a LAG-3 inhibitor, optionally wherein the LAG-3 inhibitor is selected from the group consisting of LAG525, BMS-986016, and TSR-033.

In some embodiments, the disclosure provides that the one or more additional therapeutic agents is a TIGIT inhibitor.

In some embodiments, the disclosure provides that the one or more additional therapeutic agents is a CD112R inhibitor.

In some embodiments, the disclosure provides that the one or more additional therapeutic agents is a TAM (Axl, Mer, Tyro) inhibitor.

In some embodiments, the disclosure provides that the one or more additional therapeutic agents is a 4-1BB agonist.

In some embodiments, the disclosure provides that the one or more additional therapeutic agents is a Tyrosine Kinase Inhibitor (TKI).

In an aspect, the disclosure provides an isolated SRF388 monoclonal antibody, or antigen binding portion thereof. In some embodiments, the disclosure provides that the isolated SRF388 monoclonal antibody, or antigen binding portion thereof, is administered in further combination with one or more additional therapeutic agents or procedures, selected from the group consisting of: a chemotherapy, a targeted anti-cancer therapy, an oncolytic drug, a cytotoxic agent, an immune-based therapy, a cytokine, surgical procedure, a radiation procedure, an activator of a costimulatory molecule, an inhibitor of an inhibitory molecule, a vaccine, or a cellular immunotherapy, or a combination thereof. In some embodiments, the disclosure provides that the one or more additional therapeutic agents is a PD-1 antagonist, a PD-L1 inhibitor, a TIM-3 inhibitor, a LAG-3 inhibitor, a TIGIT inhibitor, a CD112R inhibitor, a TAM inhibitor, a STING agonist, a 4-1BB agonist, a CTLA-4 inhibitor, a CD73 inhibitor, a CD39 inhibitor, an A2AR inhibitor, an IDO inhibitor, NEKTAR, peg-IL-2, peg IL-10, a CD40 agonist, or a combination thereof. In some embodiments, the disclosure provides that the PD-1 antagonist is selected from the group consisting of: PDR001, nivolumab, pembrolizumab, pidilizumab, MEDI0680, REGN2810, TSR-042, PF-06801591, AMP-224, AB122, and JTX-4014.

In one aspect, the disclosure provides a method of detecting IL-27 or EBI3 or p28 in a sample from a subject, the method comprising the steps of (a) contacting a sample from the subject with a detection antibody under conditions to permit the detection antibody to form a detection antibody-EBI3 complex or a detection antibody-p28 complex, if IL-27 or EBI3 or p28 is present in the sample, wherein the detection antibody is any of the above antibodies, or antigen binding fragments thereof, or any antibody described in Table 12; and (b) detecting the presence of the complex, if any, produced in step (a).

In one aspect, the disclosure provides a method of detecting an IL-27-associated cancer in a subject, the method comprising the steps of: (a) contacting a sample from a subject suspected of having an IL-27-associated cancer with a detection antibody under conditions to permit the detection antibody to form a detection antibody-EBI3 complex or a detection antibody-p28 complex, if IL-27 or EBI3 or p28 is present in the sample, wherein the detection antibody is any of the above antibodies, or antigen binding portions thereof, or any antibody described in Table 12; and (b) detecting the presence of the complex, if any, produced in step (a).

In some embodiments, the detection antibody is coupled to a detectable label.

In some embodiments, the method further comprises contacting the sample with a capture antibody to produce a complex comprising IL-27 or EBI3 and the capture antibody, if IL-27 or EBI3 is present in the sample, wherein the capture antibody is any of the above antibodies, or antigen binding portions thereof.

In some embodiments, the capture antibody has one or more CDRs of Ab7, optionally is Ab7.

In some embodiments, the capture antibody is immobilized on a solid support.

In some embodiments, the sample is contacted with the capture antibody before the detection antibody.

In some embodiments, the sample is a body fluid sample.

In some embodiments, the fluid sample is blood, serum, plasma, cell lysates or tissue lysates.

In some embodiments, the cancer is selected from renal cell carcinoma (RCC), hepatocellular carcinoma (HCC), lung cancer, gastroesophageal cancer, ovarian cancer, endometrial cancer, melanoma, leukemia and lymphoma.

In some embodiments, the cancer is renal cell carcinoma (RCC) or the cancer is hepatocellular carcinoma (HCC).

In some embodiments, the cancer is selected from leukemia and lymphoma or the cancer is ovarian cancer.

In some embodiments, the disclosure provides for use of any of the above isolated monoclonal antibodies, or antigen binding portions thereof, or the above pharmaceutical composition for stimulating an immune response in a subject, or for treating cancer in a subject, optionally for use in in combination with one or more additional therapeutic agents or procedure.

In some embodiments, the disclosure provides a kit comprising any of the above isolated monoclonal antibodies, or antigen binding portions thereof, or the above pharmaceutical composition and instructions for use in stimulating an immune response in a subject, or treating cancer in a subject, optionally with instructions for use in combination with one or more additional therapeutic agents or procedure.

In some embodiments, the disclosure provides a kit comprising any of the above isolated monoclonal antibodies, or antigen binding portions thereof, and instructions for use in detecting IL-27 in a sample from a subject, optionally with instructions for use to detect an IL-27-associated cancer in a subject.

In some embodiments, the disclosure provides that the above isolated monoclonal antibodies, or antigen binding portions thereof, include an antibody or antigen binding portion thereof that antagonizes IL-27.

In some embodiments, the disclosure provides that the above isolated monoclonal antibodies, or antigen binding portions thereof, include an antibody or antigen binding portion thereof inhibits or reduces STAT1 and/or STAT3 phosphorylation in a cell. In some embodiments, the disclosure provides that the above cell is an immune cell or that the cell is a cancer cell.

In some embodiments, the disclosure provides that any of the above isolated monoclonal antibodies, or antigen binding portions thereof, include an antibody or antigen binding portion thereof that inhibits or reduces inhibition of CD161 expression in a cell. In some embodiments, the disclosure provides that the cell is an immune cell.

In some embodiments, the disclosure provides that the above isolated monoclonal antibodies, or antigen binding portions thereof, include an antibody or antigen binding portion that inhibits or reduces PD-L1 and/or TIM-3 expression in a cell. In some embodiments, the disclosure provides that the cell is an immune cell or a cancer cell. In some embodiments, when the cell is a cancer cell, the antibody or antigen binding portion thereof inhibits or reduces PD-L1 expression in a cancer cell.

In some embodiments, the disclosure provides that the above isolated monoclonal antibodies, or antigen binding portions thereof, include an antibody or antigen binding portion thereof that induces or enhances the PD-1-mediated secretion of one or more cytokines from a cell. In some embodiments, the one or more cytokines is IFNg, TNFα or IL-6. In some embodiments, the one or more cytokines is IFNg, IL-17, TNFα or IL-6. In some embodiments, the one or more cytokines is TNFα. In some embodiments, the cell is an immune cell.

In some embodiments, the disclosure provides that the above isolated monoclonal antibodies, or antigen binding portions thereof, include an antibody that is selected from the group consisting of an IgG1, an IgG2, an IgG3, an IgG4, an IgM, an IgA1 an IgA2, an IgD, and an IgE antibody. In some embodiments, the antibody is an IgG1 antibody or an IgG4 antibody. In some embodiments, the antibody comprises a wild type IgG1 heavy chain constant region. In some embodiments, the antibody comprises a wild type IgG4 heavy chain constant region.

In some embodiments, the disclosure provides that the above isolated monoclonal antibodies, or antigen binding portions thereof, include an Fc domain comprising at least one mutation. In some embodiments, the antibody comprises a mutant IgG1 heavy chain constant region. In some embodiments, the antibody comprises a mutant IgG4 heavy chain constant region. In some embodiments, the mutant IgG4 heavy chain constant region comprises any one of the substitutions S228P, L235E, L235A, or a combination thereof, according to EU numbering.

In an aspect, the disclosure provides an isolated monoclonal antibody, or antigen binding portion thereof, that binds to substantially the same epitope as any of the above antibodies, or antigen binding portions thereof.

In an aspect, the disclosure provides an isolated monoclonal antibody, or antigen binding portion thereof, that binds to at least one of the amino acid residues bound by any of the above antibodies, or antigen binding portions thereof.

In an aspect, the disclosure provides an isolated monoclonal antibody, or antigen binding portion thereof, wherein a mutation of the epitope bound by the antibody or antigen binding portion thereof inhibits, reduces, or blocks binding to both the antibody or antigen binding portion thereof and to the antibody or antigen binding portion thereof according to any of the above antibodies, or antigen binding fragments thereof.

In an aspect, the disclosure provides an isolated monoclonal antibody, or antigen binding portion thereof, that binds to an epitope on IL-27, wherein the epitope is the same or is similar to the epitope bound by an antibody molecule described in Table 12.

In an aspect, the disclosure provides an isolated monoclonal antibody that specifically binds to and antagonizes human WSX-1, or antigen binding portion thereof, wherein the antibody or antigen binding portion thereof comprises heavy and light chain CDRs selected from the group consisting of heavy chain CDR1, CDR2 and CDR3 sequences set forth in SEQ ID NOs: 802, 803 and 804, respectively, and light chain CDR1, CDR2 and CDR3 sequences set forth in SEQ ID NOs: 805, 806 and 807, respectively.

In an aspect, the disclosure provides an isolated monoclonal antibody that specifically binds human WSX-1, or antigen binding portion thereof, wherein the antibody or antigen binding portion thereof comprises heavy and light chain variable regions comprising amino acid sequences selected from the group consisting of SEQ ID NO: 794 and 796, respectively.

In an aspect, the disclosure provides an isolated monoclonal antibody that specifically binds human WSX-1, or antigen binding portion thereof, comprises a light chain constant region, wherein the light chain constant region comprises the amino acid sequence set forth in SEQ ID NO: 798.

In an aspect, the disclosure provides an isolated monoclonal antibody that specifically binds human WSX-1, or antigen binding portion thereof, wherein the antibody or antigen binding portion thereof comprises heavy and light chain CDRs at least 90% identical to the group consisting of heavy chain CDR1, CDR2 and CDR3 sequences set forth in SEQ ID NOs: 802, 803 and 804, respectively, and at least 90% identical to the group consisting of light chain CDR1, CDR2 and CDR3 sequences set forth in SEQ ID NOs: 805, 806 and 807, respectively In an aspect, the disclosure provides an isolated monoclonal antibody that specifically binds human WSX-1, or antigen binding portion thereof, wherein the antibody or antigen binding portion thereof comprises heavy and light chain variable regions at least 90% identical to the group consisting of SEQ ID NO: 794 and 796, respectively In an aspect, the disclosure provides an isolated monoclonal antibody that specifically binds human WSX-1, or antigen binding portion thereof, comprises a light chain constant region, wherein the light chain constant region is at least 90% identical to the amino acid sequence set forth in SEQ ID NO: 798.

In some embodiments, the disclosure provides a pharmaceutical composition comprising an isolated monoclonal antibody or antigen binding portion thereof, of any of the above WSX-1 binding antibodies, and a pharmaceutically acceptable carrier.

In some embodiments, the disclosure provides a nucleic acid comprising a nucleotide sequence encoding the light chain, heavy chain, or both light and heavy chains of the isolated monoclonal antibody, or antigen binding portion thereof, of any one of the above WSX-1 binding antibodies. In some embodiments, the disclosure provides an expression vector comprising the aforementioned nucleic acid. In some embodiments, the disclosure provides a cell transformed with the aforementioned expression vector. In some embodiments, the disclosure provides a method for producing a monoclonal antibody that specifically binds human WSX-1, or an antigen binding portion thereof, the method comprising maintaining the aforementioned cell under conditions permitting expression of the monoclonal antibody or antigen binding portion thereof. In some embodiments, the disclosure provides a method of detecting WSX-1 in a sample from a subject, the method comprising the steps of (a) contacting a sample from the subject with a detection antibody under conditions to permit the detection antibody to form a detection antibody-WSX-1 complex, if WSX-1 is present in the sample, wherein the detection antibody is an antibody, or antigen binding fragment thereof, according to any one of the above WSX-1 binding antibodies; and (b) detecting the presence of the complex, if any, produced in step (a).

In some embodiments, the disclosure provides a method of detecting a WSX-1-associated cancer in a subject, the method comprising the steps of: (a) contacting a sample from a subject suspected of having an WSX-1-associated cancer with a detection antibody under conditions to permit the detection antibody to form a detection antibody-WSX-1 complex, if WSX-1 is present in the sample, wherein the detection antibody is an antibody, or antigen binding portion thereof, according to any one of the above WSX-1 binding antibodies; and (b) detecting the presence of the complex, if any, produced in step (a).

In some embodiments, the disclosure provides use of the isolated monoclonal antibody, or antigen binding portion thereof, of any one of the above WSX-1 binding antibodies or the above pharmaceutical composition for stimulating an immune response in a subject, or for treating cancer in a subject, optionally for use in in combination with one or more additional therapeutic agents or procedure.

In some embodiments, the disclosure provides a kit comprising the isolated monoclonal antibody, or antigen binding portion thereof, of any one of the above WSX-1 binding antibodies or the above pharmaceutical composition and instructions for use in stimulating an immune response in a subject, or treating cancer in a subject, optionally with instructions for use in combination with one or more additional therapeutic agents or procedure.

Definitions

Terms used in the claims and specification are defined as set forth below unless otherwise specified.

It must be noted that, as used in the specification and the appended claims, the singular forms "a," "an" and "the" include plural references unless the context clearly dictates otherwise.

As used herein, "about" will be understood by persons of ordinary skill and will vary to some extent depending on the context in which it is used. If there are uses of the term which are not clear to persons of ordinary skill given the context in which it is used, "about" will mean up to plus or minus 10% of the particular value.

As used herein, the term "agonist" refers to any molecule that partially or fully promotes, induces, increases, and/or activates a biological activity of a native polypeptide disclosed herein. Suitable agonist molecules specifically include agonist antibodies or antibody fragments, fragments or amino acid sequence variants of native polypeptides, peptides or proteins. In some embodiments, activation in the presence of the agonist is observed in a dose-dependent manner. In some embodiments, the measured signal (e.g., biological activity) is at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% higher than the signal measured with a negative control under comparable conditions. Also disclosed herein, are methods of identifying agonists suitable for use in the methods of the disclosure. For example, these methods include, but are not limited to, binding assays such as enzyme-linked immuno-absorbent assay (ELISA), Forte Bio© systems, and radioimmunoassay (RIA). These assays determine the ability of an agonist to bind the polypeptide of interest (e.g., a receptor or ligand) and therefore indicate the ability of the agonist to promote, increase or activate the activity of the polypeptide. Efficacy of an agonist can also be determined using functional assays, such as the ability of an agonist to activate or promote the function of the polypeptide. For example, a functional assay may comprise contacting a polypeptide with a candidate agonist molecule and measuring a detectable change in one or more biological activities normally associated with the polypeptide. The potency of an agonist is usually defined by its $EC_{50}$ value (concentration required to activate 50% of the agonist response). The lower the $EC_{50}$ value the greater the potency of the agonist and the lower the concentration that is required to activate the maximum biological response.

As used herein, the term "alanine scanning" refers to a technique used to determine the contribution of a specific wild-type residue to the stability or function(s) (e.g., binding affinity) of given protein or polypeptide. The technique involves the substitution of an alanine residue for a wild-type residue in a polypeptide, followed by an assessment of the stability or function(s) (e.g., binding affinity) of the alanine-substituted derivative or mutant polypeptide and comparison to the wild-type polypeptide. Techniques to substitute alanine for a wild-type residue in a polypeptide are known in the art.

The term "ameliorating" refers to any therapeutically beneficial result in the treatment of a disease state, e.g., cancer, including prophylaxis, lessening in the severity or progression, remission, or cure thereof.

As used herein, the term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, γ-carboxyglutamate, and O-phosphoserine. Amino acid analogs refers to compounds that have the same basic chemical structure as a naturally occurring amino acid, i.e., an a carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. Amino acid mimetics refers to chemical compounds that have a structure that is different from the general chemical structure of an amino acid, but that function in a manner similar to a naturally occurring amino acid.

Amino acids can be referred to herein by either their commonly known three letter symbols or by the one-letter symbols recommended by the IUPAC-IUB Biochemical Nomenclature Commission. Nucleotides, likewise, can be referred to by their commonly accepted single-letter codes.

As used herein, an "amino acid substitution" refers to the replacement of at least one existing amino acid residue in a predetermined amino acid sequence (an amino acid sequence of a starting polypeptide) with a second, different "replacement" amino acid residue. An "amino acid insertion" refers to the incorporation of at least one additional amino acid into a predetermined amino acid sequence. While the insertion will usually consist of the insertion of one or two amino acid residues, larger "peptide insertions," can also be made, e.g. insertion of about three to about five or even up to about ten, fifteen, or twenty amino acid residues. The inserted residue(s) may be naturally occurring or non-naturally occurring as disclosed above. An "amino acid deletion" refers to the removal of at least one amino acid residue from a predetermined amino acid sequence.

As used herein, the term "amount" or "level" is used in the broadest sense and refers to a quantity, concentration or abundance of a substance (e.g., a metabolite, a small molecule, a protein, an mRNA, a marker). When referring to a metabolite or small molecule (e.g. a drug), the terms "amount", "level" and "concentration" are generally used interchangeably and generally refer to a detectable amount in a biological sample. "Elevated levels" or "increased levels" refers to an increase in the quantity, concentration or abundance of a substance within a sample relative to a control sample, such as from an individual or individuals who are not suffering from the disease or disorder (e.g., cancer) or an internal control. In some embodiments, the elevated level of a substance (e.g., a drug) in a sample refers to an increase in the amount of the substance of about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or 100% relative to the amount of the substance in a control sample, as determined by techniques known in the art (e.g., HPLC). "Reduced levels" refers to a decrease in the quantity, concentration or abundance of a substance (e.g., a drug) in an individual relative to a control, such as from an individual or individuals who are not suffering from the disease or disorder (e.g., cancer) or an internal control. In some embodiments, a reduced level is little or no detectable quantity, concentration or abundance. In some embodiments, the reduced level of a substance (e.g., a drug) in a sample refers to a decrease in the amount of the substance of about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or 100% relative to the amount of the substance in a control sample, as determined by techniques known in the art (e.g., HPLC).

When referring to a protein, mRNA or a marker, such as those described herein, the terms "level of expression" or "expression level" in general are used interchangeably and generally refer to a detectable amount of a protein, mRNA, or marker in a biological sample. In some aspects, a detectable amount or detectable level of a protein, mRNA or a marker is associated with a likelihood of a response to an agent, such as those described herein. "Expression" generally refers to the process by which information contained within a gene is converted into the structures (e.g., a protein marker, such as PD-L1) present and operating in the cell. Therefore, as used herein, "expression" may refer to transcription into a polynucleotide, translation into a polypeptide, or even polynucleotide and/or polypeptide modifications (e.g., posttranslational modification of a polypeptide). Fragments of the transcribed polynucleotide, the translated polypeptide, or polynucleotide and/or polypeptide modifications (e.g., posttranslational modification of a polypeptide) shall also be regarded as expressed whether they originate from a transcript generated by alternative splicing or a degraded transcript, or from a post-translational processing of the polypeptide, e.g., by proteolysis. "Expressed genes" include those that are transcribed into a polynucleotide as mRNA and then translated into a polypeptide, and also those that are transcribed into RNA but not translated into a polypeptide (for example, transfer and ribosomal RNAs). "Elevated expression," "elevated expression levels," or "elevated levels" refers to an increased expression or increased levels of a substance within a sample relative to a control sample, such as an individual or individuals who are not suffering from the disease or disorder (e.g., cancer) or an internal control. In some embodiments, the elevated expression of a substance (e.g., a protein marker, such as PD-L1) in a sample refers to an increase in the amount of the substance of about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or 100% relative to the amount of the substance in a control sample, as determined by techniques known in the art (e.g., FACS). "Reduced expression," "reduced expression levels," or "reduced levels" refers to a decrease expression or decreased levels of a substance (e.g., a protein marker) in an individual relative to a control, such as an individual or individuals who are not suffering from the disease or disorder (e.g., cancer) or an internal control. In some embodiments, reduced expression is little or no expression. In some embodiments, the reduced expression of a substance (e.g., a protein marker) in a sample refers to a decrease in the amount of the substance of about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or 100% relative to the amount of the substance in a control sample, as determined by techniques known in the art (e.g., FACS).

As used herein, the term "angiogenesis" or "neovascularization" refers to the process by, which new blood vessels develop from pre-existing vessels (Varner et al., (1999) Angiogen. 3:53-60: Mousa et al., (2000) Angiogen. Sorin. Inhib. 35:42-44; Kim et al., (2000) Amer. J. Path. 156:1345-1.362; Kim et al., (2000) J. Biol. Chem. 275:33920-33928; Kumar et al. (2000) Angiogenesis: From Molecular to Integrative Pharm, 169-180). Endothelial cells from pre-existing blood vessels or from circulating endothelial stem cells (Takahashi et al., (1995) Nat. Med. 5:434-438; Isner et al., (1999) J. Clin. Invest. 103:1231-1236) become activated to migrate, proliferate, and differentiate into structures with lumens, forming new blood vessels, in response to growth factor or hormonal cues, or hypoxic or ischemic conditions. During ischemia, such as occurs in cancer, the need to increase oxygenation and delivery of nutrients apparently induces the secretion of angiogenic factors by the affected tissue; these factors stimulate new blood vessel formation. Several additional terms are related to angiogenesis.

As used herein, the term "antagonist" refers to any molecule that partially or fully blocks, inhibits, or neutralizes a biological activity of a native polypeptide disclosed herein. Suitable antagonist molecules specifically include antagonist antibodies or antibody fragments, fragments or amino acid sequence variants of native polypeptides, peptides or proteins. In some embodiments, inhibition in the presence of the antagonist is observed in a dose-dependent manner. In some embodiments, the measured signal (e.g., biological activity) is at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% lower than the signal measured with a negative control under comparable conditions. Also disclosed herein, are methods of identifying antagonists suitable for use in the methods of the disclosure. For example, these methods include, but are not limited to, binding assays such as enzyme-linked immuno-absorbent assay (ELISA), Forte Bio© systems, radioimmunoassay (RIA), Meso Scale Discovery assay (e.g., Meso Scale Discovery Electrochemiluminescence (MSD-ECL), and bead-based Luminex® assay. These assays determine the ability of an antagonist to bind the polypeptide of interest (e.g., a receptor or ligand) and therefore indicate the ability of the antagonist to inhibit, neutralize or block the activity of the polypeptide. Efficacy of an antagonist can also be determined using functional assays, such as the ability of an antagonist to inhibit the function of the polypeptide or an agonist. For example, a functional assay may comprise contacting a polypeptide with a candidate antagonist molecule and measuring a detectable change in one or more biological activities normally associated with the polypeptide. The potency of an antagonist is usually defined by its $IC_{50}$ value (concentration required to inhibit 50% of the agonist response). The lower the $IC_{50}$ value the greater the potency of the antagonist and the lower the concentration that is required to inhibit the maximum biological response.

As used herein, the phrase "antibody that antagonizes human IL-27, or an antigen binding portion thereof" refers to an antibody that antagonizes at least one art-recognized activity of human IL-27 (e.g., IL-27 biological activity and/or downstream pathway(s) mediated by IL-27 signaling or other IL-27-mediated function), for example, relating to a decrease (or reduction) in human IL-27 activity that is at least 5%, 10%, 20%, 30%, 40%, 50%, 60%, 70%, 80%, 90%, or more. Additional examples of IL-27 biological activities and/or downstream pathway(s) mediated by IL-27 signaling or other IL-27-mediated function are described in additional detail below and elsewhere herein.

As used herein, the term "anti-IL-27 antagonist antibody" (interchangeably termed "anti-IL-27 antibody") refers to an antibody that specifically binds to IL-27 and inhibits IL-27 biological activity and/or downstream pathway(s) mediated by IL-27 signaling or other IL-27-mediated function. An anti-IL-27 antagonist antibody encompasses antibodies that block, antagonize, suppress, inhibit or reduce an IL-27 biological activity (e.g., ligand binding, enzymatic activity), including downstream pathways mediated by IL-27 signaling or function, such as receptor binding and/or elicitation of a cellular response to IL-27 or its metabolites. In some embodiments, an anti-IL-27 antagonist antibody provided by the disclosure binds to human IL-27 and prevents, blocks, or inhibits binding of human IL-27 to its cognate or normal receptor (e.g., IL-27 receptor), or one or more receptor subunits (e.g., gp130 and/or IL-27Rα (also known as WSX1/TCCR)). In some embodiments, the anti-IL-27 antagonist antibody prevents, blocks, or inhibits the binding of human IL-27 to the gp130. In some embodiments, the anti-IL-27 antagonist antibody prevents, blocks, or inhibits the binding of human IL-27 to the IL-27Rα. In some embodiments, the anti-IL-27 antagonist antibody prevents, blocks, or inhibits the dimerization of IL-27 monomers. In some embodiments, the anti-IL-27 antibody specifically binds to the EBI3 monomer. In some embodiments, the anti-IL-27 antibody specifically binds to the IL-27p28 monomer. In some embodiments, the anti-IL-27 antibody specifically binds to both IL-27 monomers. In some embodiments, the anti-IL-27 antibody specifically binds to a non-contiguous epitope comprising both EBI3 and P28. In some embodiments, the anti-IL-27 antibody inhibits or reduces STAT1 and/or STAT3 phosphorylation in a cell. In some embodiments, the anti-IL-27 antibody inhibits or reduces inhibition of CD161 expression in a cell (e.g., ameliorates or relieves IL-27 mediated inhibition of CD161 expression in a cell). In some embodiments, the anti-IL-27 antibody inhibits or reduces PD-L1 and/or TIM-3 expression in a cell. In some embodiments, the anti-IL-27 induces or enhances PD-1-mediated secretion of one or more cytokines from a cell. In some embodiments, an anti-IL-27 antagonist antibody binds to human IL-27 and stimulates or enhances an anti-tumor response. In some embodiments, the anti-IL-27 antagonist antibody binds to human IL-27 with an affinity of 15 nM or less. In some embodiments, the anti-IL-27 antagonist antibody binds to human IL-27 and comprises a wild type or mutant IgG1 heavy chain constant region or a wild type or mutant IgG4 heavy chain constant region. Examples of anti-IL-27 antagonist antibodies are provided herein.

As used herein, the term "antibody" refers to a whole antibody comprising two light chain polypeptides and two heavy chain polypeptides. Whole antibodies include different antibody isotypes including IgM, IgG, IgA, IgD, and IgE antibodies. The term "antibody" includes a polyclonal antibody, a monoclonal antibody, a chimerized or chimeric antibody, a humanized antibody, a primatized antibody, a deimmunized antibody, and a fully human antibody. The antibody can be made in or derived from any of a variety of species, e.g., mammals such as humans, non-human primates (e.g., orangutan, baboons, or chimpanzees), horses, cattle, pigs, sheep, goats, dogs, cats, rabbits, guinea pigs, gerbils, hamsters, rats, and mice. The antibody can be a purified or a recombinant antibody. As used herein, the term "antibody fragment," "antigen-binding fragment," or similar terms refer to a fragment of an antibody that retains the ability to bind to a target antigen (e.g., IL-27) and inhibit the activity of the target antigen. Such fragments include, e.g., a single chain antibody, a single chain Fv fragment (scFv), an Fd fragment, an Fab fragment, an Fab' fragment, or an F(ab')$_2$ fragment. An scFv fragment is a single polypeptide chain that includes both the heavy and light chain variable regions of the antibody from which the scFv is derived. In addition, intrabodies, minibodies, triabodies, and diabodies are also included in the definition of antibody and are compatible for use in the methods described herein. See, e.g., Todorovska et al., (2001) *J. Immunol. Methods* 248(1): 47-66; Hudson and Kortt, (1999) *J. Immunol. Methods* 231(1):177-189; Poljak, (1994) *Structure* 2(12):1121-1123; Rondon and Marasco, (1997) *Annu. Rev. Microbiol.* 51:257-283, the disclosures of each of which are incorporated herein by reference in their entirety.

As used herein, the term "antibody fragment" also includes, e.g., single domain antibodies such as camelized single domain antibodies. See, e.g., Muyldermans et al., (2001) *Trends Biochem. Sci.* 26:230-235; Nuttall et al., (2000) *Curr. Pharm. Biotech.* 1:253-263; Reichmann et al., (1999) *J Immunol. Meth.* 231:25-38; PCT application publication nos. WO 94/04678 and WO 94/25591; and U.S. Pat. No. 6,005,079, all of which are incorporated herein by reference in their entireties. In some embodiments, the disclosure provides single domain antibodies comprising two VH domains with modifications such that single domain antibodies are formed.

In some embodiments, an antigen-binding fragment includes the variable region of a heavy chain polypeptide and the variable region of a light chain polypeptide. In some embodiments, an antigen-binding fragment described herein comprises the CDRs of the light chain and heavy chain polypeptide of an antibody.

The term "antigen presenting cell" or "APC" is a cell that displays foreign antigen complexed with MHC on its surface. T cells recognize this complex using T cell receptor (TCR). Examples of APCs include, but are not limited to, B cells, dendritic cells (DCs), peripheral blood mononuclear cells (PBMC), monocytes (such as THP-1), B lymphoblastoid cells (such as C1R.A2, 1518 B-LCL) and monocyte-derived dendritic cells (DCs). Some APCs internalize antigens either by phagocytosis or by receptor-mediated endocytosis.

The term "antigen presentation" refers to the process by which APCs capture antigens and enables their recognition by T cells, e.g., as a component of an MHC-I and/or MHC-II conjugate.

As used herein, the term "apoptosis" refers to the process of programmed cell death that occurs in multicellular organisms (e.g. humans). The highly-regulated biochemical and molecular events that result in apoptosis can lead to observable and characteristic morphological changes to a cell, including membrane blebbing, cell volume shrinkage, chromosomal DNA condensation and fragmentation, and mRNA decay. A common method to identify cells, including T cells, undergoing apoptosis is to expose cells to a fluorophore-conjugated protein (Annexin V). Annexin V is commonly used to detect apoptotic cells by its ability to bind to phosphatidylserine on the outer leaflet of the plasma membrane, which is an early indicator that the cell is undergoing the process of apoptosis.

As used herein, the term "B cell" (alternatively "B lymphocyte") refers to a type of white blood cell of the lymphocyte subtype. B cells function in the humoral immunity component of the adaptive immune system by secreting antibodies. B cells also present antigen and secrete cytokines. B cells, unlike the other two classes of lymphocytes, T cells and natural killer cells, express B cell receptors (BCRs) on their cell membrane. BCRs allow the B cell to bind to a specific antigen, against which it will initiate an antibody response.

As used herein, the term "binds to immobilized IL-27," refers to the ability of an antibody of the disclosure to bind to IL-27, for example, expressed on the surface of a cell or which is attached to a solid support.

As used herein, the term "bispecific" or "bifunctional antibody" refers to an artificial hybrid antibody having two different heavy/light chain pairs and two different binding sites. Bispecific antibodies can be produced by a variety of methods including fusion of hybridomas or linking of Fab' fragments. See, e.g., Songsivilai & Lachmann, (1990) *Clin. Exp. Immunol.* 79:315-321; Kostelny et al., (1992) *J. Immunol.* 148:1547-1553.

Traditionally, the recombinant production of bispecific antibodies is based on the co-expression of two immunoglobulin heavy-chain/light-chain pairs, where the two heavy chain/light-chain pairs have different specificities (Milstein and Cuello, (1983) Nature 305:537-539). Antibody variable domains with the desired binding specificities (antibody-antigen combining sites) can be fused to immunoglobulin constant domain sequences. The fusion of the heavy chain variable region is preferably with an immunoglobulin heavy-chain constant domain, including at least part of the hinge, CH2, and CH3 regions. For further details of illustrative currently known methods for generating bispecific antibodies see, e.g., Suresh et al., (1986) *Methods Enzymol.* 121:210; PCT Publication No. WO 96/27011; Brennan et al., (1985) *Science* 229:81; Shalaby et al., *J. Exp. Med.* (1992) 175:217-225; Kostelny et al., (1992) *J. Immunol.* 148(5): 1547-1553; Hollinger et al., (1993) *Proc. Natl. Acad. Sci. USA* 90:6444-6448; Gruber et al., (1994) *J. Immunol.* 152: 5368; and Tutt et al., (1991) *J. Immunol.* 147:60. Bispecific antibodies also include cross-linked or heteroconjugate antibodies. Heteroconjugate antibodies may be made using any convenient cross-linking methods. Suitable cross-linking agents are well known in the art, and are disclosed in U.S. Pat. No. 4,676,980, along with a number of cross-linking techniques.

Various techniques for making and isolating bispecific antibody fragments directly from recombinant cell culture have also been described. For example, bispecific antibodies have been produced using leucine zippers. See, e.g., Kostelny et al. (1992) J Immunol 148(5):1547-1553. The leucine zipper peptides from the Fos and Jun proteins may be linked to the Fab' portions of two different antibodies by gene fusion. The antibody homodimers may be reduced at the hinge region to form monomers and then re-oxidized to form the antibody heterodimers. This method can also be utilized for the production of antibody homodimers. The "diabody" technology described by Hollinger et al. (1993) Proc Natl Acad Sci USA 90:6444-6448 has provided an alternative mechanism for making bispecific antibody fragments. The fragments comprise a heavy-chain variable domain (VH) connected to a light-chain variable domain (VL) by a linker which is too short to allow pairing between the two domains on the same chain. Accordingly, the VH and VL domains of one fragment are forced to pair with the complementary VL and VH domains of another fragment, thereby forming two antigen-binding sites. Another strategy for making bispecific antibody fragments by the use of single-chain Fv (scFv) dimers has also been reported. See, e.g., Gruber et al. (1994) J Immunol 152:5368. Alternatively, the antibodies can be "linear antibodies" as described in, e.g., Zapata et al. (1995) Protein Eng. 8(10):1057-1062. Briefly, these antibodies comprise a pair of tandem Fd segments (VH-CH1-VH-CH1) which form a pair of antigen binding regions. Linear antibodies can be bispecific or monospecific.

Antibodies with more than two valencies (e.g., trispecific antibodies) are contemplated and described in, e.g., Tutt et al. (1991) J Immunol 147:60.

The disclosure also embraces variant forms of multispecific antibodies such as the dual variable domain immunoglobulin (DVD-Ig) molecules described in Wu et al. (2007) Nat Biotechnol 25(11): 1290-1297. The DVD-Ig molecules are designed such that two different light chain variable domains (VL) from two different parent antibodies are linked in tandem directly or via a short linker by recombinant DNA techniques, followed by the light chain constant domain. Similarly, the heavy chain comprises two different heavy chain variable domains (VH) linked in tandem, followed by the constant domain CH1 and Fc region. Methods for making DVD-Ig molecules from two parent antibodies are further described in, e.g., PCT Publication Nos. WO 08/024188 and WO 07/024715. In some embodiments, the bispecific antibody is a Fabs-in-Tandem immunoglobulin, in which the light chain variable region with a second specificity is fused to the heavy chain variable region of a whole antibody. Such antibodies are described in, e.g., International Patent Application Publication No. WO 2015/103072.

As used herein, "cancer antigen" or "tumor antigen" refers to (i) tumor-specific antigens, (ii) tumor-associated antigens, (iii) cells that express tumor-specific antigens, (iv) cells that express tumor-associated antigens, (v) embryonic antigens on tumors, (vi) autologous tumor cells, (vii) tumor-specific membrane antigens, (viii) tumor-associated membrane antigens, (ix) growth factor receptors, (x) growth factor ligands, and (xi) any other type of antigen or antigen-presenting cell or material that is associated with a cancer.

As used herein, the term "cancer-specific immune response" refers to the immune response induced by the presence of tumors, cancer cells, or cancer antigens. In certain embodiments, the response includes the proliferation of cancer antigen specific lymphocytes. In certain embodiments, the response includes expression and upregulation of antibodies and T-cell receptors and the formation and release of lymphokines, chemokines, and cytokines. Both innate and acquired immune systems interact to initiate antigenic responses against the tumors, cancer cells, or cancer antigens. In certain embodiments, the cancer-specific immune response is a T cell response.

The term "carcinoma" is art recognized and refers to malignancies of epithelial or endocrine tissues including respiratory system carcinomas, gastrointestinal system carcinomas, genitourinary system carcinomas, testicular carcinomas, breast carcinomas, prostatic carcinomas, endocrine system carcinomas, and melanomas. The anti-IL-27 antibodies described herein can be used to treat patients who have, who are suspected of having, or who may be at high risk for developing any type of cancer, including renal carcinoma or melanoma, or any viral disease. Exemplary carcinomas include those forming from tissue of the cervix, lung, prostate, breast, head and neck, colon and ovary. The term also includes carcinosarcomas, which include malignant tumors composed of carcinomatous and sarcomatous tissues. An "adenocarcinoma" refers to a carcinoma derived from glandular tissue or in which the tumor cells form recognizable glandular structures.

As used herein, the term "CD112R" refers to a member of poliovirus receptor-like proteins and is a co-inhibitory receptor for human T cells. CD112R is preferentially expressed on T cells and inhibits T cell receptor-mediated signals. CD112, widely expressed on antigen-presenting cells and tumor cells, is the ligand for CD112R. CD112R competes with CD226 to bind to CD112. Disrupting the CD112R-CD112 interaction enhances human T cell response. CD112R as a novel checkpoint for human T cells via interaction with CD112. As used herein the term "CD112R inhibitor" refers to an agent that disrupts, blocks or inhibits the biological function or activity of CD112R.

As used herein, the term "CD137" (alternatively "4-1BB") refers to a member of the tumor necrosis factor (TNF) receptor superfamily. 4-1BB is a co-stimulatory immune checkpoint molecule, primarily for activated T cells. Crosslinking of CD137 enhances T cell proliferation, IL-2 secretion, survival and cytolytic activity. As used herein, the term "4-1BB agonist" refers to an agent that stimulates, induces or increases one or more function of 4-1BB. An exemplary 4-1BB agonist is Utomilumab (PF-05082566), a fully human IgG2 monoclonal antibody that targets this 4-1BB to stimulate T cells.

As used herein, the term "CD161" (alternatively known as Killer cell lectin-like receptor subfamily B, member 1 (KLRB1); NK1.1, or NKR-P1A) refers to a member of the C-type lectin superfamily. CD161 is a marker of T cells and CD161 expression has been associated with T cell infiltration into the tumor microenvironment for a number of different cancer types. CD161 is further described in Fergusson et al., (2014) Cell Reports 9(3):1075-1088, which is incorporated herein by reference it its entirety.

As used herein, the term "IL-27" or "interleukin 27" refers to the IL-27 cytokine. IL-27 is related to the IL-6/IL-12 cytokine families, and is a heterodimeric cytokine that comprises a first subunit known as Epstein-Barr Virus Induced Gene 3 (EBI3; also known as IL-27 subunit β and IL-27B) and a second subunit known as IL-27p28 (also known as IL30, IL-27 subunit α and IL-27A). IL-27 is predominantly synthesized by activated antigen-presenting cells including monocytes, endothelial cells and dendritic cells (Jankowski et al. (2010) Arch Immunol. Ther. Exp. 58:417-425, Diakowski et al. (2013) Adv. Clin. Exp. Med. (2013) 22(5): 683-691). Although IL-27 can have proinflammatory effects, many studies suggest an important role of IL-27 as an immunosuppressive agent (Shimizu et al. (2006) J. Immunol. 176:7317-7324, Hisada et al. (2004) Cancer Res. 64:1152-1156, Diakowski (2013) supra). Although it was initially described as a factor promoting the initiation of Th1 responses, IL-27 was later found to play a major T-cell suppressive function by limiting Th1 responses, inhibiting Th2 and Th17 cell differentiation, and regulating the development of Tr1 and other T regulatory cell populations (Dietrich et al. (2014) J. Immunol. 192:5382-5389). In addition to its role as an immunoregulator, IL-27 also regulates angiogenesis, hematopoiesis, and osteocalstogenesis (Id.).

IL-27 signals through a heterodimeric type I cytokine receptor (the IL-27 receptor or IL-27R) that comprises a first subunit known as WSX1 (also known as IL-27 receptor subunit α, IL-27RA, T-Cell Cytokine Receptor Type 1 (TCCR), and Cytokine Receptor-Like 1 (CRL1)) and a second subunit known as gp130 (also known as Interleukin-6 Signal Transducer (IL6ST), Interleukin-6 Receptor Subunit β (IL-6RB), and Oncostatin M Receptor). gp130 is also a receptor subunit for the IL-6 family cytokines (Liu et al. (2008) Scan. J. Immunol. 68:22-299, Diakowski (2013) supra). IL-27 signaling through IL-27R activates multiple signaling cascades, including the JAK-STAT and p38 MAPK pathways.

EBI3 is also believed to have biological functions independent of p28 or the IL-27 heterodimer. For example, EBI3 also interacts with p35 to form the heterodimeric cytokine IL-35 (Yoshida et al. (2015) Annu. Rev Immunol. 33:417-43) and has been shown to be selectively overexpressed in certain cell types without a corresponding increase in p28 or IL-27 (Larousserie et al. (2005) Am. J. Pathol. 166(4):1217-28).

```
An amino acid sequence of an exemplary human EBI3 protein is provided in SEQ ID NO: 698 (NCBI Reference Sequence: NP_005746.2; N-

MTPQLLLALVLWASCPPCSGRKGPPAALTLPRVQCRASRYPIAVDCSWTLPPAPNSTSPV

SFIATYRLGMAARGHSWPCLQQTPTSTSCTITDVQLFSMAPYVLNVTAVHPWGSSSSFV

PFITEHIIKPDPPEGVRLSPLAERQLQVQWEPPGSWPFPEIFSLKYWIRYKRQGAARFHRV

GPIEATSFILRAVRPRARYYVQVAAQDLTDYGELSDWSLPATATMSLGK-C).

An amino acid sequence of an exemplary human p28 protein is provided in SEQ ID

NO: 699 (NCBI Reference Sequence: NP_663634.2; N-

MGQTAGDLGWRLSLLLLPLLLVQAGVWGFPRPPGRPQLSLQELRREFTVSLHLARKLLS

EVRGQAHRFAESHLPGVNLYLLPLGEQLPDVSLTFQAWRRLSDPERLCFISTTLQPFHAL

LGGLGTQGRWTNMERMQLWAMRLDLRDLQRHLRFQVLAAGFNLPEEEEEEEEEEEEE

RKGLLPGALGSALQGPAQVSWPQLLSTYRLLHSLELVLSRAVRELLLLSKAGHSVWPLG

FPTLSPQP-C).

An amino acid sequence of an exemplary human WSX1 protein is provided in

SEQ ID NO: 700 (NCBI Reference Sequence: NP_004834.1; N-

MRGGRGAPFWLWPLPKLALLPLLWVLFQRTRPQGSAGPLQCYGVGPLGDLNCSWEPL

GDLGAPSELHLQSQKYRSNKTQTVAVAAGRSWVAIPREQLTMSDKLLVWGTKAGQPL

WPPVFVNLETQMKPNAPRLGPDVDFSEDDPLEATVHWAPPTWPSHKVLICQFHYRRCQ

EAAWTLLEPELKTIPLTPVEIQDLELATGYKVYGRCRMEKEEDLWGEWSPILSFQTPPSA

PKDVWVSGNLCGTPGGEEPLLLWKAPGPCVQVSYKVWFWVGGRELSPEGITCCCSLIPS

GAEWARVSAVNATSWEPLTNLSLVCLDSASAPRSVAVSSIAGSTELLVTWQPGPGEPLE

HVVDWARDGDPLEKLNWVRLPPGNLSALLPGNFTVGVPYRITVTAVSASGLASASSVW

GFREELAPLVGPTLWRLQDAPPGTPAIAWGEVPRHQLRGHLTHYTLCAQSGTSPSVCM

NVSGNTQSVTLPDLPWGPCELWVTASTIAGQGPPGPILRLHLPDNTLRWKVLPGILFLW

GLFLLGCGLSLATSGRCYHLRHKVLPRWVWEKVPDPANSSSGQPHMEQVPEAQPLGDL

PILEVEEMEPPPVMESSQPAQATAPLDSGYEKHFLPTPEELGLLGPPRPQVLA-C).

An amino acid sequence of an exemplary human gp130 protein is provided in

SEQ ID NO: 701 (NCBI Reference Sequence: NP_002175.2; N-

MLTLQTWLVQALFIFLTTESTGELLDPCGYISPESPVVQLHSNFTAVCVLKEKCMDYFH

VNANYIVWKTNHFTIPKEQYTIINRTASSVTFTDIASLNIQLTCNILTFGQLEQNVYGITIIS

GLPPEKPKNLSCIVNEGKKMRCEWDGGRETHLETNFTLKSEWATHKFADCKAKRDTPT

SCTVDYSTVYFVNIEVWVEAENALGKVTSDHINFDPVYKVKPNPPHNLSVINSEELSSIL

KLTWTNPSIKSVIILKYNIQYRTKDASTWSQIPPEDTASTRSSFTVQDLKPFTEYVFRIRC
```

-continued

```
MKEDGKGYWSDWSEEASGITYEDRPSKAPSFWYKIDPSHTQGYRTVQLVWKTLPPFEA

NGKILDYEVTLTRWKSHLQNYTVNATKLTVNLTNDRYLATLTVRNLVGKSDAAVLTIP

ACDFQATHPVMDLKAFPKDNMLWVEWTTPRESVKKYILEWCVLSDKAPCITDWQQED

GTVHRTYLRGNLAESKCYLITVTPVYADGPGSPESIKAYLKQAPPSKGPTVRTKKVGKN

EAVLEWDQLPVDVQNGFIRNYTIFYRTIIGNETAVNVDSSHTEYTLSSLTSDTLYMVRM

AAYTDEGGKDGPEFTFTTPKFAQGEIEAIVVPVCLAFLLTTLLGVLFCFNKRDLIKKHIWP

NVPDPSKSHIAQWSPHTPPRHNFNSKDQMYSDGNFTDVSVVEIEANDKKPFPEDLKSLD

LFKKEKINTEGHSSGIGGSSCMSSSRPSISSSDENESSQNTSSTVQYSTVVHSGYRHQVPS

VQVFSRSESTQPLLDSEERPEDLQLVDHVDGGDGILPRQQYFKQNCSQUESSPDISHFER

SKQVSSVNEEDFVRLKQQISDHISQSCGSGQMKMFQEVSAADAFGPGTEGQVERFETVG

MEAATDEG1VIPKSYLPQTVRQGGYMPQ-C).
```

As used herein the term "compete", when used in the context of antigen-binding proteins (e.g., immunoglobulins, antibodies, or antigen-binding fragments thereof) that compete for binding to the same epitope, refers to a interaction between antigen-binding proteins as determined by an assay (e.g., a competitive binding assay; a cross-blocking assay), wherein a test antigen-binding protein (e.g., a test antibody) inhibits (e.g., reduces or blocks) specific binding of a reference antigen-binding protein (e.g., a reference antibody) to a common antigen (e.g., IL-27 or a fragment thereof).

A polypeptide or amino acid sequence "derived from" a designated polypeptide or protein refers to the origin of the polypeptide. Preferably, the polypeptide or amino acid sequence which is derived from a particular sequence has an amino acid sequence that is essentially identical to that sequence or a portion thereof, wherein the portion consists of at least 10-20 amino acids, preferably at least 20-30 amino acids, more preferably at least 30-50 amino acids, or which is otherwise identifiable to one of ordinary skill in the art as having its origin in the sequence. Polypeptides derived from another peptide may have one or more mutations relative to the starting polypeptide, e.g., one or more amino acid residues which have been substituted with another amino acid residue or which has one or more amino acid residue insertions or deletions.

A polypeptide can comprise an amino acid sequence which is not naturally occurring. Such variants necessarily have less than 100% sequence identity or similarity with the starting molecule. In certain embodiments, the variant will have an amino acid sequence from about 75% to less than 100% amino acid sequence identity or similarity with the amino acid sequence of the starting polypeptide, more preferably from about 80% to less than 100%, more preferably from about 85% to less than 100%, more preferably from about 90% to less than 100% (e.g., 91%, 92%, 93%, 94%, 95%, 96%, 97%, 98%, 99%) and most preferably from about 95% to less than 100%, e.g., over the length of the variant molecule.

In certain embodiments, there is one amino acid difference between a starting polypeptide sequence and the sequence derived there from. Identity or similarity with respect to this sequence is defined herein as the percentage of amino acid residues in the candidate sequence that are identical (i.e., same residue) with the starting amino acid residues, after aligning the sequences and introducing gaps, if necessary, to achieve the maximum percent sequence identity. In certain embodiments, a polypeptide consists of, consists essentially of, or comprises an amino acid sequence selected from a sequence set forth in Table 12. In certain embodiments, a polypeptide includes an amino acid sequence at least 80%, 81%, 82%, 83%, 84%, 85%, 86%, 87%, 88%, 89%, 90%, 91%, 92%, 93%, 94%, 95%, 96%, 97%, 98%, or 99% identical to an amino acid sequence selected from a sequence set forth in Table 12. In certain embodiments, a polypeptide includes a contiguous amino acid sequence at least 80%, 81%, 82%, 83%, 84%, 85%, 86%, 87%, 88%, 89%, 90%, 91%, 92%, 93%, 94%, 95%, 96%, 97%, 98%, or 99% identical to a contiguous amino acid sequence selected from a sequence set forth in Table 12. In certain embodiments, a polypeptide includes an amino acid sequence having at least 10, 15, 20, 25, 30, 35, 40, 45, 50, 55, 60, 65, 70, 75, 80, 85, 90, 95, 100, 200, 300, 400, or 500 (or any integer within these numbers) contiguous amino acids of an amino acid sequence selected from a sequence set forth in Table 12.

In certain embodiments, the antibodies of the disclosure are encoded by a nucleotide sequence. Nucleotide sequences of the invention can be useful for a number of applications, including: cloning, gene therapy, protein expression and purification, mutation introduction, DNA vaccination of a host in need thereof, antibody generation for, e.g., passive immunization, PCR, primer and probe generation, and the like. In certain embodiments, the nucleotide sequence of the invention comprises, consists of, or consists essentially of, a nucleotide sequence selected from a sequence set forth in Table 12. In certain embodiments, a nucleotide sequence includes a nucleotide sequence at least 80%, 81%, 82%, 83%, 84%, 85%, 86%, 87%, 88%, 89%, 90%, 91%, 92%, 93%, 94%, 95%, 96%, 97%, 98%, or 99% identical to a nucleotide sequence selected from a sequence set forth in Table 12. In certain embodiments, a nucleotide sequence includes a contiguous nucleotide sequence at least 80%, 81%, 82%, 83%, 84%, 85%, 86%, 87%, 88%, 89%, 90%, 91%, 92%, 93%, 94%, 95%, 96%, 97%, 98%, or 99% identical to a contiguous nucleotide sequence selected from a sequence set forth in Table 12. In certain embodiments, a nucleotide sequence includes a nucleotide sequence having at least 10, 15, 20, 25, 30, 35, 40, 45, 50, 55, 60, 65, 70, 75, 80, 85, 90, 95, 100, 200, 300, 400, or 500 (or any integer within these numbers) contiguous nucleotides of a nucleotide sequence selected from a sequence set forth in Table 12.

It will also be understood by one of ordinary skill in the art that the antibodies suitable for use in the methods disclosed herein may be altered such that they vary in sequence from the naturally occurring or native sequences from which they were derived, while retaining the desirable activity of the native sequences. For example, nucleotide or amino acid substitutions leading to conservative substitutions or changes at "non-essential" amino acid residues may be made. Mutations may be introduced by standard techniques, such as site-directed mutagenesis and PCR-mediated mutagenesis.

The antibodies suitable for use in the methods disclosed herein may comprise conservative amino acid substitutions at one or more amino acid residues, e.g., at essential or non-essential amino acid residues. A "conservative amino acid substitution" is one in which the amino acid residue is replaced with an amino acid residue having a similar side chain. Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a nonessential amino acid residue in a binding polypeptide is preferably replaced with another amino acid residue from the same side chain family. In certain embodiments, a string of amino acids can be replaced with a structurally similar string that differs in order and/or composition of side chain family members. Alternatively, in certain embodiments, mutations may be introduced randomly along all or part of a coding sequence, such as by saturation mutagenesis, and the resultant mutants can be incorporated into binding polypeptides of the invention and screened for their ability to bind to the desired target.

As used herein, the term antigen "cross-presentation" refers to presentation of exogenous protein antigens to T cells via MEW class I and class II molecules on APCs.

As used herein, the term "cross-reacts" refers to the ability of an antibody of the disclosure to bind to IL-27 from a different species. For example, an antibody of the present disclosure which binds human IL-27 may also bind another species of IL-27. As used herein, cross-reactivity is measured by detecting a specific reactivity with purified antigen in binding assays (e.g., SPR, ELISA) or binding to, or otherwise functionally interacting with, cells physiologically expressing IL-27. Methods for determining cross-reactivity include standard binding assays as described herein, for example, by Biacore™ surface plasmon resonance (SPR) analysis using a Biacore 2000 SPR instrument (Biacore AB, Uppsala, Sweden), or flow cytometric techniques.

As used herein, the term "cytotoxic T lymphocyte (CTL) response" refers to an immune response induced by cytotoxic T cells. CTL responses are mediated primarily by CD8+ T cells.

As used herein, the term "dendritic cell" or "DC" refers to type of antigen-presenting cells that are bone marrow (BM)-derived leukocytes and are the most potent type of antigen-presenting cells. DCs are capture and process antigens, converting proteins to peptides that are presented on major histocompatibility complex (MEW) molecules recognized by T cells. DCs are heterogeneous, e.g. myeloid and plasmacytoid DCs; although all DCs are capable of antigen uptake, processing and presentation to naive T cells, the DC subtypes have distinct markers and differ in location, migratory pathways, detailed immunological function and dependence on infections or inflammatory stimuli for their generation. During the development of an adaptive immune response, the phenotype and function of DCs play a role in initiating tolerance, memory, and polarized T-helper 1 (Th1), Th2 and Th17 differentiation.

As used herein, the term "dendritic cell activation" refers to the transition from immature to mature dendritic cell; and the activated dendritic cells encompass mature dendritic cells and dendritic cells in the process of the transition, wherein the expression of CD80 and CD86 that induce costimulatory signals are elevated by the activating stimuli. Mature human dendritic cells are cells that are positive for the expression of CD40, CD80, CD86, and HLA-class II (e.g., HLA-DR). An immature dendritic cell can be distinguished from a mature dendritic cell, for example, based on markers selected from the group consisting of CD80 and CD86. An immature dendritic cell is weakly positive and preferably negative for these markers, while a mature dendritic cell is positive. Discrimination of mature dendritic cells is routinely performed by those skilled in the art, and the respective markers described above and methods for measuring their expression are also well known to those skilled in the art.

As used herein, the term "$EC_{50}$" refers to the concentration of an antibody or an antigen-binding portion thereof, which induces a response, either in an in vitro or an in vivo assay, which is 50% of the maximal response, i.e., halfway between the maximal response and the baseline.

As used herein, the term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts effective for this use will depend upon the severity of the disorder being treated and the general state of the patient's own immune system.

As used herein, the term "epitope" or "antigenic determinant" refers to a site on an antigen to which an immunoglobulin or antibody specifically binds. The term "epitope mapping" refers to a process or method of identifying the binding site, or epitope, of an antibody, or antigen binding fragment thereof, on its target protein antigen. Epitope mapping methods and techniques are provided herein. Epitopes can be formed both from contiguous amino acids or noncontiguous amino acids juxtaposed by tertiary folding of a protein. Epitopes formed from contiguous amino acids are typically retained on exposure to denaturing solvents, whereas epitopes formed by tertiary folding are typically lost on treatment with denaturing solvents. An epitope typically includes at least 3, 4, 5, 6, 7, 8, 9, 10, 11, 12, 13, 14 or 15 amino acids in a unique spatial conformation. Methods for determining what epitopes are bound by a given antibody (i.e., epitope mapping) are well known in the art and include, for example, immunoblotting and immunoprecipitation assays, wherein overlapping or contiguous peptides from IL-27 are tested for reactivity with the given anti-IL-27 antibody. Methods of determining spatial conformation of epitopes include techniques in the art and those described herein, for example, x-ray crystallography and 2-dimensional nuclear magnetic resonance (see, e.g., *Epitope Mapping Protocols in Methods in Molecular Biology*, Vol. 66, G. E. Morris, Ed. (1996)).

Also encompassed by the present disclosure are antibodies that bind to an epitope on IL-27 which comprises all or a portion of an epitope recognized by the particular antibodies described herein (e.g., the same or an overlapping region or a region between or spanning the region).

Also encompassed by the present disclosure are antibodies that bind the same epitope and/or antibodies that compete for binding to human IL-27 with the antibodies described herein. Antibodies that recognize the same epitope or compete for binding can be identified using routine techniques. Such techniques include, for example, an immunoassay, which shows the ability of one antibody to block the binding of another antibody to a target antigen, i.e., a competitive binding assay. Competitive binding is determined in an assay in which the immunoglobulin under test inhibits specific binding of a reference antibody to a common antigen, such as IL-27. Numerous types of competitive binding assays are known, for example: solid phase direct or indirect radioimmunoassay (MA), solid phase direct or indirect enzyme immunoassay (EIA), sandwich competition assay (see Stahli et al., *Methods in Enzymology* 9:242 (1983)); solid phase direct biotin-avidin EIA (see Kirkland et al., *J. Immunol.* 137:3614 (1986)); solid phase direct labeled assay, solid phase direct labeled sandwich assay (see Harlow and Lane, *Antibodies: A Laboratory Manual*, Cold Spring Harbor Press (1988)); solid phase direct label MA using 1-125 label (see Morel et al., *Mol. Immunol.* 25(1):7 (1988)); solid phase direct biotin-avidin EIA (Cheung et al., *Virology* 176:546 (1990)); and direct labeled MA. (Moldenhauer et al., *Scand. J. Immunol.* 32:77 (1990)). Typically, such an assay involves the use of purified antigen bound to a solid surface or cells bearing either of these, an unlabeled test immunoglobulin and a labeled reference immunoglobulin. Competitive inhibition is measured by determining the amount of label bound to the solid surface or cells in the presence of the test immunoglobulin. Usually the test immunoglobulin is present in excess. Usually, when a competing antibody is present in excess, it will inhibit specific binding of a reference antibody to a common antigen by at least 50-55%, 55-60%, 60-65%, 65-70% 70-75% or more.

Other techniques include, for example, epitope mapping methods, such as, x-ray analyses of crystals of antigen:antibody complexes which provides atomic resolution of the epitope and mass spectrometry combined with hydrogen/deuterium (H/D) exchange which studies the conformation and dynamics of antigen:antibody interactions. Other methods monitor the binding of the antibody to antigen fragments or mutated variations of the antigen where loss of binding due to a modification of an amino acid residue within the antigen sequence is often considered an indication of an epitope component. In addition, computational combinatorial methods for epitope mapping can also be used. These methods rely on the ability of the antibody of interest to affinity isolate specific short peptides from combinatorial phage display peptide libraries. The peptides are then regarded as leads for the definition of the epitope corresponding to the antibody used to screen the peptide library. For epitope mapping, computational algorithms have also been developed which have been shown to map conformational discontinuous epitopes.

As used herein, the term "Fc-mediated effector functions" or "Fc effector functions" refer to the biological activities of an antibody other than the antibody's primary function and purpose. For example, the effector functions of a therapeutic agnostic antibody are the biological activities other than the activation of the target protein or pathway. Examples of antibody effect functions include C1q binding and complement dependent cytotoxicity; Fc receptor binding; antibody-dependent cell-mediated cytotoxicity (ADCC); phagocytosis; down regulation of cell surface receptors (e.g., B cell receptor); lack of activation of platelets that express Fc receptor; and B cell activation. Many effector functions begin with Fc binding to an Fcγ receptor. In some embodiments, the tumor antigen-targeting antibody has effector function, e.g., ADCC activity. In some embodiments, a tumor antigen-targeting antibody described herein comprises a variant constant region having increased effector function (e.g. increased ability to mediate ADCC) relative to the unmodified form of the constant region.

As used herein, the term "Fc receptor" refers to a polypeptide found on the surface of immune effector cells, which is bound by the Fc region of an antibody. In some embodiments, the Fc receptor is an Fcγ receptor. There are three subclasses of Fcγ receptors, FcγRI (CD64), FcγRII (CD32) and FγcRIII (CD16). All four IgG isotypes (IgG1, IgG2, IgG3 and IgG4) bind and activate Fc receptors FcγRI, FcγRIIA and FcγRIIIA FcγRIIB is an inhibitory receptor, and therefore antibody binding to this receptor does not activate complement and cellular responses. FcγRI is a high affinity receptor that binds to IgG in monomeric form, whereas FcγRIIA and FcγRIIA are low affinity receptors that bind IgG only in multimeric form and have slightly lower affinity. The binding of an antibody to an Fc receptor and/or C1q is governed by specific residues or domains within the Fc regions. Binding also depends on residues located within the hinge region and within the CH2 portion of the antibody. In some embodiments, the agonistic and/or therapeutic activity of the antibodies described herein is dependent on binding of the Fc region to the Fc receptor (e.g., FcγR). In some embodiments, the agonistic and/or therapeutic activity of the antibodies described herein is enhanced by binding of the Fc region to the Fc receptor (e.g., FcγR).

A list of certain Fc receptor sequences employed in the instant disclosure is set forth as Table 13 below.

As used herein, the term "glycosylation pattern" is defined as the pattern of carbohydrate units that are covalently attached to a protein, more specifically to an immunoglobulin protein. A glycosylation pattern of a heterologous antibody can be characterized as being substantially similar to glycosylation patterns which occur naturally on antibodies produced by the species of the nonhuman transgenic animal, when one of ordinary skill in the art would recognize the glycosylation pattern of the heterologous antibody as being more similar to said pattern of glycosylation in the species of the nonhuman transgenic animal than to the species from which the CH genes of the transgene were derived.

As used herein, the term "human antibody" includes antibodies having variable and constant regions (if present) of human germline immunoglobulin sequences. Human antibodies of the disclosure can include amino acid residues not encoded by human germline immunoglobulin sequences (e.g., mutations introduced by random or site-specific mutagenesis in vitro or by somatic mutation in vivo) (See, e.g., Lonberg et al., (1994) *Nature* 368(6474): 856-859); Lonberg, (1994) *Handbook of Experimental Pharmacology* 113: 49-101; Lonberg & Huszar, (1995) *Intern. Rev. Immunol.* 13:65-93, and Harding & Lonberg, (1995) *Ann. N.Y. Acad. Sci.* 764:536-546). However, the term "human antibody" does not include antibodies in which CDR sequences derived from the germline of another mammalian species, such as a mouse, have been grafted onto human framework sequences (i.e. humanized antibodies).

As used herein, the term a "heterologous antibody" is defined in relation to the transgenic non-human organism producing such an antibody. This term refers to an antibody having an amino acid sequence or an encoding nucleic acid sequence corresponding to that found in an organism not consisting of the transgenic non-human animal, and generally from a species other than that of the transgenic non-human animal.

The terms "inducing an immune response" and "enhancing an immune response" are used interchangeably and refer the stimulation of an immune response (i.e., either passive or adaptive) to a particular antigen. The terms "induce" as used with respect to inducing CDC or ADCC refer to the stimulation of particular direct cell killing mechanisms.

As used herein, the term "immunogenic cell death" (alternatively known as "immunogenic apoptosis" refers to a cell death modality associated with the activation of one or more signaling pathways that induces the pre-mortem expression and emission of damaged-associated molecular pattern (DAMPs) molecules (e.g., adenosine triphosphate, ATP) from the tumor cell, resulting in the increase of immunogenicity of the tumor cell and the death of the tumor cell in an immunogenic manner (e.g., by phagocytosis). As used herein, the term "immunogenic cell death-inducing agent" refers to a chemical, biological, or pharmacological agent that induces an immunogenic cell death process, pathway, or modality.

As used herein, the terms "inhibits", "reduces" or "blocks" (e.g., referring to inhibition or reduction of human IL-27-mediated phosphorylation of STAT1 and/or STAT3 in a cell) are used interchangeably and encompass both partial and complete inhibition/blocking. The inhibition/blocking of IL-27 reduces or alters the normal level or type of activity that occurs without inhibition or blocking. Inhibition and blocking are also intended to include any measurable decrease in the binding affinity of IL-27 when in contact with an anti-IL-27 antibody as compared to IL-27 not in contact with an anti-IL-27 antibody, e.g., inhibits binding of IL-27 by at least about 10%, 15%, 20%, 25%, 30%, 35%, 40%, 45%, 50%, 55%, 60%, 65%, 70%, 75%, 80%, 85%, 90%, 95%, 96%, 97%, 98%, 99%, or 100%.

As used herein, the terms "inhibits angiogenesis," "diminishes angiogenesis," and "reduces angiogenesis" refer to reducing, the level of angiogenesis in a tissue to a quantity which is at least 10%, 15%, 20%, 25%, 30%, 35%, 40%, 45%, 50%, 55%, 60%, 65%, 70%, 75%, 80%, 85%, 90%, 95%, 99% or less than the quantity in a corresponding control tissue, and most preferably is at the same level which is observed in a control tissue.

As used herein, the term "inhibits growth" (e.g., referring to cells) is intended to include any measurable decrease in the growth of a cell, e.g., the inhibition of growth of a cell by at least about 10%, 20%, 30%, 40%, 50%, 60%, 70%, 80%, 90%, 99%, or 100%.

As used herein, a subject "in need of prevention," "in need of treatment," or "in need thereof," refers to one, who by the judgment of an appropriate medical practitioner (e.g., a doctor, a nurse, or a nurse practitioner in the case of humans; a veterinarian in the case of non-human mammals), would reasonably benefit from a given treatment (such as treatment with a composition comprising an anti-IL-27 antibody).

The term "in vivo" refers to processes that occur in a living organism.

As used herein, the term "isolated antibody" is intended to refer to an antibody which is substantially free of other antibodies having different antigenic specificities (e.g., an isolated antibody that specifically binds to human IL-27 is substantially free of antibodies that specifically bind antigens other than IL-27). An isolated antibody that specifically binds to an epitope may, however, have cross-reactivity to other IL-27 proteins from different species. However, the antibody continues to display specific binding to human IL-27 in a specific binding assay as described herein. In addition, an isolated antibody is typically substantially free of other cellular material and/or chemicals. In some embodiments, a combination of "isolated" antibodies having different IL-27 specificities is combined in a well-defined composition.

As used herein, the term "isolated nucleic acid molecule" refers to nucleic acids encoding antibodies or antibody portions (e.g., VH, VL, CDR3) that bind to IL-27, is intended to refer to a nucleic acid molecule in which the nucleotide sequences encoding the antibody or antibody portion are free of other nucleotide sequences encoding antibodies or antibody portions that bind antigens other than IL-27, which other sequences may naturally flank the nucleic acid in human genomic DNA. For example, a sequence selected from a sequence set forth in Table 12 corresponds to the nucleotide sequences comprising the heavy chain (VH) and light chain (VL) variable regions of anti-IL-27 antibody monoclonal antibodies described herein.

As used herein, "isotype" refers to the antibody class (e.g., IgM or IgG1) that is encoded by heavy chain constant region genes. In some embodiments, a human monoclonal antibody of the disclosure is of the IgG1 isotype. In some embodiments, a human monoclonal antibody of the disclosure is of the IgG2 isotype. In some embodiments, a human monoclonal antibody of the disclosure is of the IgG3 isotype. In some embodiments, a human monoclonal antibody of the disclosure is of the IgG4 isotype. As is apparent to a skilled artisan, identification of antibody isotypes (e.g., IgG1, IgG2, IgG3, IgG4, IgM, IgA1 IgA2, IgD, and IgE) is routine in the art and commonly involves a combination of sequence alignments with known antibodies, published Fc variant sequences and conserved sequences.

As used herein, the term "isotype switching" refers to the phenomenon by which the class, or isotype, of an antibody changes from one Ig class to one of the other Ig classes.

As used herein the term "KD" or "$K_D$" refers to the equilibrium dissociation constant of a binding reaction between an antibody and an antigen. The value of $K_D$ is a numeric representation of the ratio of the antibody off-rate constant (kd) to the antibody on-rate constant (ka). The value of $K_D$ is inversely related to the binding affinity of an antibody to an antigen. The smaller the $K_D$ value the greater the affinity of the antibody for its antigen. Affinity is the strength of binding of a single molecule to its ligand and is typically measured and reported by the equilibrium dissociation constant ($K_D$), which is used to evaluate and rank order strengths of bimolecular interactions.

As used herein, the term "kd" or "$k_d$" (alternatively "koff" or "$k_{off}$") is intended to refer to the off-rate constant for the dissociation of an antibody from an antibody/antigen complex. The value of kd is a numeric representation of the fraction of complexes that decay or dissociate per second, and is expressed in units $sec^{-1}$.

As used herein, the term "ka" or "$k_a$" (alternatively "kon" or "$k_{on}$") is intended to refer to the on-rate constant for the association of an antibody with an antigen. The value of ka is a numeric representation of the number of antibody/antigen complexes formed per second in a 1 molar (1M) solution of antibody and antigen, and is expressed in units $M^{-1}sec^{-1}$.

As used herein, the term "leukocyte" refers to a type of white blood cell involved in defending the body against infective organisms and foreign substances. Leukocytes are produced in the bone marrow. There are 5 main types of white blood cells, subdivided between 2 main groups: polymorphonuclear leukocytes (neutrophils, eosinophils, basophils) and mononuclear leukocytes (monocytes and lymphocytes).

As used herein, the term "lymphocytes" refers to a type of leukocyte or white blood cell that is involved in the immune defenses of the body. There are two main types of lymphocytes: B-cells and T-cells.

As used herein, the terms "linked," "fused", or "fusion", are used interchangeably. These terms refer to the joining together of two more elements or components or domains, by whatever means including chemical conjugation or recombinant means. Methods of chemical conjugation (e.g., using heterobifunctional crosslinking agents) are known in the art.

As used herein, "local administration" or "local delivery," refers to delivery that does not rely upon transport of the composition or agent to its intended target tissue or site via the vascular system. For example, the composition may be delivered by injection or implantation of the composition or agent or by injection or implantation of a device containing the composition or agent. Following local administration in the vicinity of a target tissue or site, the composition or agent, or one or more components thereof, may diffuse to the intended target tissue or site.

As used herein, "MHC molecules" refers to two types of molecules, MHC class I and MHC class II. MHC class I molecules present antigen to specific CD8+ T cells and MHC class II molecules present antigen to specific CD4+ T cells. Antigens delivered exogenously to APCs are processed primarily for association with MHC class II. In contrast, antigens delivered endogenously to APCs are processed primarily for association with MHC class I.

As used herein, the term "monoclonal antibody" refers to an antibody which displays a single binding specificity and affinity for a particular epitope. Accordingly, the term "human monoclonal antibody" refers to an antibody which displays a single binding specificity and which has variable and optional constant regions derived from human germline immunoglobulin sequences. In some embodiments, human monoclonal antibodies are produced by a hybridoma which includes a B cell obtained from a transgenic non-human animal, e.g., a transgenic mouse, having a genome comprising a human heavy chain transgene and a light chain transgene fused to an immortalized cell.

As used herein, the term "monocyte" refers to a type of leukocyte and can differentiate into macrophages and dendritic cells to effect an immune response.

As used herein, the term "natural killer (NK) cell" refers to a type of cytotoxic lymphocyte. These are large, usually granular, non-T, non-B lymphocytes, which kill certain tumor cells and play an important in innate immunity to viruses and other intracellular pathogens, as well as in antibody-dependent cell-mediated cytotoxicity (ADCC).

As used herein, the term "naturally-occurring" as applied to an object refers to the fact that an object can be found in nature. For example, a polypeptide or polynucleotide sequence that is present in an organism (including viruses) that can be isolated from a source in nature and which has not been intentionally modified by man in the laboratory is naturally-occurring.

As used herein, the term "nonswitched isotype" refers to the isotypic class of heavy chain that is produced when no isotype switching has taken place; the CH gene encoding the nonswitched isotype is typically the first CH gene immediately downstream from the functionally rearranged VDJ gene. Isotype switching has been classified as classical or non-classical isotype switching. Classical isotype switching occurs by recombination events which involve at least one switch sequence region in the transgene. Non-classical isotype switching may occur by, for example, homologous recombination between human $\sigma_\mu$ and human $\Sigma_\mu$ ($\delta$-associated deletion). Alternative non-classical switching mechanisms, such as intertransgene and/or interchromosomal recombination, among others, may occur and effectuate isotype switching.

As used herein, the term "nucleic acid" refers to deoxyribonucleotides or ribonucleotides and polymers thereof in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions) and complementary sequences and as well as the sequence explicitly indicated. Specifically, degenerate codon substitutions can be achieved by generating sequences in which the third position of one or more selected (or all) codons is substituted with mixed-base and/or deoxyinosine residues (Batzer et al., Nucleic Acid Res. 19:5081, 1991; Ohtsuka et al., Biol. Chem. 260:2605-2608, 1985; and Cassol et al, 1992; Rossolini et al, Mol. Cell. Probes 8:91-98, 1994). For arginine and leucine, modifications at the second base can also be conservative. The term nucleic acid is used interchangeably with gene, cDNA, and mRNA encoded by a gene.

Polynucleotides used herein can be composed of any polyribonucleotide or polydeoxribonucleotide, which can be unmodified RNA or DNA or modified RNA or DNA. For example, polynucleotides can be composed of single- and double-stranded DNA, DNA that is a mixture of single- and double-stranded regions, single- and double-stranded RNA, and RNA that is mixture of single- and double-stranded regions, hybrid molecules comprising DNA and RNA that can be single-stranded or, more typically, double-stranded or a mixture of single- and double-stranded regions. In addition, the polynucleotide can be composed of triple-stranded regions comprising RNA or DNA or both RNA and DNA. A polynucleotide can also contain one or more modified bases or DNA or RNA backbones modified for stability or for other reasons. "Modified" bases include, for example, tritylated bases and unusual bases such as inosine. A variety of modifications can be made to DNA and RNA; thus, "polynucleotide" embraces chemically, enzymatically, or metabolically modified forms.

A nucleic acid is "operably linked" when it is placed into a functional relationship with another nucleic acid sequence. For instance, a promoter or enhancer is operably linked to a coding sequence if it affects the transcription of the sequence. With respect to transcription regulatory sequences, operably linked means that the DNA sequences being linked are contiguous and, where necessary to join two protein coding regions, contiguous and in reading frame. For switch sequences, operably linked indicates that the sequences are capable of effecting switch recombination.

As used herein, "parenteral administration," "administered parenterally," and other grammatically equivalent phrases, refer to modes of administration other than enteral and topical administration, usually by injection, and include, without limitation, intravenous, intranasal, intraocular, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural, intracerebral, intracranial, intracarotid and intrasternal injection and infusion.

As used herein, the term "patient" includes human and other mammalian subjects that receive either prophylactic or therapeutic treatment.

As used herein, the term "PD-1 antagonist" refers to any chemical compound or biological molecule that inhibits the PD-1 signaling pathway or that otherwise inhibits PD-1 function in a cell (e.g. an immune cell). In some embodiments, a PD-1 antagonist blocks binding of PD-L1 to PD-1 and/or PD-L2 to PD-1. In some embodiments, the PD-1 antagonist specifically binds PD-1. In some embodiments, the PD-1 antagonist specifically binds PD-L1.

The term "percent identity," in the context of two or more nucleic acid or polypeptide sequences, refer to two or more sequences or subsequences that have a specified percentage of nucleotides or amino acid residues that are the same, when compared and aligned for maximum correspondence, as measured using one of the sequence comparison algorithms described below (e.g., BLASTP and BLASTN or other algorithms available to persons of skill) or by visual inspection. Depending on the application, the "percent identity" can exist over a region of the sequence being compared, e.g., over a functional domain, or, alternatively, exist over the full length of the two sequences to be compared. For sequence comparison, typically one sequence acts as a reference sequence to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally Ausubel et al., infra).

One example of an algorithm that is suitable for determining percent sequence identity and sequence similarity is the BLAST algorithm, which is described in Altschul et al., J. Mol. Biol. 215:403-410 (1990). Software for performing BLAST analyses is publicly available through the National Center for Biotechnology Information website.

As generally used herein, "pharmaceutically acceptable" refers to those compounds, materials, compositions, and/or dosage forms which are, within the scope of sound medical judgment, suitable for use in contact with the tissues, organs, and/or bodily fluids of human beings and animals without excessive toxicity, irritation, allergic response, or other problems or complications commensurate with a reasonable benefit/risk ratio.

As used herein, a "pharmaceutically acceptable carrier" refers to, and includes, any and all solvents, dispersion media, coatings, antibacterial and antifungal agents, isotonic and absorption delaying agents, and the like that are physiologically compatible. The compositions can include a pharmaceutically acceptable salt, e.g., an acid addition salt or a base addition salt (see, e.g., Berge et al. (1977) *J Pharm Sci* 66:1-19).

As used herein, the terms "polypeptide," "peptide", and "protein" are used interchangeably to refer to a polymer of amino acid residues. The terms apply to amino acid polymers in which one or more amino acid residue is an artificial chemical mimetic of a corresponding naturally occurring amino acid, as well as to naturally occurring amino acid polymers and non-naturally occurring amino acid polymer.

As used herein, the term "preventing" when used in relation to a condition, refers to administration of a composition which reduces the frequency of, or delays the onset of, symptoms of a medical condition in a subject relative to a subject which does not receive the composition.

As used herein, the term "purified" or "isolated" as applied to any of the proteins (antibodies or fragments) described herein refers to a polypeptide that has been separated or purified from components (e.g., proteins or other naturally-occurring biological or organic molecules) which naturally accompany it, e.g., other proteins, lipids, and nucleic acid in a prokaryote expressing the proteins. Typically, a polypeptide is purified when it constitutes at least 60 (e.g., at least 65, 70, 75, 80, 85, 90, 92, 95, 97, or 99) %, by weight, of the total protein in a sample.

As used herein, the term "Programmed Cell Death Protein 1" or "PD-1" refers to the Programmed Cell Death Protein 1 polypeptide, an immune-inhibitory receptor belonging to the CD28 family and is encoded by the PDCD1 gene in humans. Alternative names or synonyms for PD-1 include: PDCD1, PD1, CD279 and SLEB2. PD-1 is expressed predominantly on previously activated T cells, B cells, and myeloid cells in vivo, and binds to two ligands, PD-L1 and PD-L2. The term "PD-1" as used herein includes human PD-1 (hPD-1), variants, isoforms, and species homologs of hPD-1, and analogs having at least one common epitope with hPD-1. The complete hPD-1 sequence can be found under GenBank Accession No. AAC51773.

As used herein, the term "Programmed Death Ligand-1" or "PD-L1" is one of two cell surface glycoprotein ligands for PD-1 (the other being PD-L2) that downregulates T cell activation and cytokine secretion upon binding to PD-1. Alternative names and synonyms for PD-L1 include: PDCD1L1, PDL1, B7H1, B7-4, CD274 and B7-H. The term "PD-L1" as used herein includes human PD-L1 (hPD-L1), variants, isoforms, and species homologs of hPD-L1, and analogs having at least one common epitope with hPD-L1. The complete hPD-L1 sequence can be found under GenBank Accession No. Q9NZQ7.

PD-1 is known as an immune-inhibitory protein that negatively regulates TCR signals (Ishida, Y. et al. (1992) EMBO J. 11:3887-3895; Blank, C. et al. (Epub 2006 Dec. 29) Immunol. Immunother. 56(5):739-745). The interaction between PD-1 and PD-L1 can act as an immune checkpoint, which can lead to a decrease in T-cell receptor mediated proliferation (Dong et al. (2003) J. Mol. Med. 81:281-7; Blank et al. (2005) Cancer Immunol. Immunother. 54:307-314; Konishi et al. (2004) Clin. Cancer Res. 10:5094-100). Immune suppression can be reversed by inhibiting the local interaction of PD-1 with PD-L1 or PD-L2; the effect is additive when the interaction of PD-1 with PD-L2 is blocked as well (Iwai et al. (2002) Proc. Nat'l. Acad. Sci. USA 99:12293-7; Brown et al. (2003) J. Immunol. 170:1257-66).

For several cancers, tumor survival and proliferation is sustained by tumor-mediated immune checkpoint modulation. This modulation can result in the disruption of anti-cancer immune system functions. For example, recent studies have indicated that the expression of immune checkpoint receptors ligands, such as PD-L1 or PD-L2, by tumor cells can downregulate immune system activity in the tumor microenvironment and promote cancer immune evasion, particularly by suppressing T cells. PD-L1 is abundantly expressed by a variety of human cancers (Dong et al., (2002) Nat Med 8:787-789). The receptor for PD-L1, PD-1, is expressed on lymphocytes (e.g., activated T cells) and is normally involved in down-regulating the immune system and promoting self-tolerance, particularly by suppressing T cells. However, when PD-1 receptors expressed on T cells bind to cognate PD-L1 ligands on tumor cells, the resulting T cell suppression contributes to an impaired immune response against the tumor (e.g., a decrease in tumor infiltrating lymphocytes or the establishment of immune evasion by cancer cells).

In large sample sets of e.g. ovarian, renal, colorectal, pancreatic, liver cancers and melanoma, it was shown that PD-L1 expression correlated with poor prognosis and reduced overall survival irrespective of subsequent treatment (see e.g., Dong et al., (2002) Nat Med 8(8):793-800; Yang et al., (2008) Invest Ophthalmol Vis Sci 49(6):2518-2525; Ghebeh et al., (2006) Neoplasia 8:190-198; Hamanishi et al., (2007) Proc Nat Acad Sci USA 104:3360-3365; Thompson et al., (2006) Clin Genitourin Cancer 5:206-211; Nomi et al., (2005) Clin Cancer Res 11:2947-2953; Inman et al., (2007) Cancer 109:1499-1505; Shimauchi et al., (2007) Int J Cancer 121:2585-2590; Gao et al., (2009) Clin Cancer Res 15:971-979; Nakanishi et al., (2007) Cancer Immunol Immunother 56:1173-1182; Hino et al., (2010) Cancer 116(7):1757-1766). Similarly, PD-1 expression on tumor lymphocytes was found to mark dysfunctional T cells in breast cancer (Kitano et al., (2017) ESMO Open 2(2): e000150) and melanoma (Kleffel et al., (2015) Cell 162(6): 1242-1256). PD-1 antagonists, such as those that affect the function of the PD-1/PD-L1/PD-L2 signaling axis and/or disrupt the interaction between PD-1 and PD-L1 and/or PD-L2, for example, have been developed and represent a novel class of anti-tumor inhibitors that function via modulation of immune cell-tumor cell interaction.

As used herein, the term "rearranged" refers to a configuration of a heavy chain or light chain immunoglobulin locus wherein a V segment is positioned immediately adjacent to a D-J or J segment in a conformation encoding essentially a complete VH or VL domain, respectively. A rearranged immunoglobulin gene locus can be identified by comparison to germline DNA; a rearranged locus will have at least one recombined heptamer/nonamer homology element.

As used herein, the term "recombinant host cell" (or simply "host cell") is intended to refer to a cell into which a recombinant expression vector has been introduced. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "host cell" as used herein.

As used herein, the term "recombinant human antibody" includes all human antibodies that are prepared, expressed, created or isolated by recombinant means, such as (a) antibodies isolated from an animal (e.g., a mouse) that is transgenic or transchromosomal for human immunoglobulin genes or a hybridoma prepared therefrom, (b) antibodies isolated from a host cell transformed to express the antibody, e.g., from a transfectoma, (c) antibodies isolated from a recombinant, combinatorial human antibody library, and (d) antibodies prepared, expressed, created or isolated by any other means that involve splicing of human immunoglobulin gene sequences to other DNA sequences. Such recombinant human antibodies comprise variable and constant regions that utilize particular human germline immunoglobulin sequences are encoded by the germline genes, but include subsequent rearrangements and mutations which occur, for example, during antibody maturation. As known in the art (see, e.g., Lonberg (2005) Nature Biotech. 23(9):1117-1125), the variable region contains the antigen binding domain, which is encoded by various genes that rearrange to form an antibody specific for a foreign antigen. In addition to rearrangement, the variable region can be further modified by multiple single amino acid changes (referred to as somatic mutation or hypermutation) to increase the affinity of the antibody to the foreign antigen. The constant region will change in further response to an antigen (i.e., isotype switch). Therefore, the rearranged and somatically mutated nucleic acid molecules that encode the light chain and heavy chain immunoglobulin polypeptides in response to an antigen may not have sequence identity with the original nucleic acid molecules, but instead will be substantially identical or similar (i.e., have at least 80% identity).

As used herein, the term "reference antibody" (used interchangeably with "reference mAb") or "reference antigen-binding protein" refers to an antibody, or an antigen-binding fragment thereof, that binds to a specific epitope on IL-27 and is used to establish a relationship between itself and one or more distinct antibodies, wherein the relationship is the binding of the reference antibody and the one or more distinct antibodies to the same epitope on IL-27. As used herein, the term connotes an anti-IL-27 antibody that is useful in a test or assay, such as those described herein, (e.g., a competitive binding assay), as a competitor, wherein the assay is useful for the discovery, identification or development, of one or more distinct antibodies that bind to the same epitope.

As used herein, the terms "specific binding," "selective binding," "selectively binds," and "specifically binds," refer to antibody binding to an epitope on a predetermined antigen. Typically, the antibody binds with an equilibrium dissociation constant ($K_D$) of approximately less than $10^{-6}$ M, such as approximately less than $10^{-7}$, $10^{-8}$M, $10^{-9}$M or $10^{-10}$ M or even lower when determined by surface plasmon resonance (SPR) technology in a BIACORE 2000 instrument using recombinant human IL-27 as the analyte and the antibody as the ligand and binds to the predetermined antigen with an affinity that is at least two-fold greater than its affinity for binding to a non-specific antigen (e.g., BSA, casein) other than the predetermined antigen or a closely-related antigen. In certain embodiments, an antibody that specifically binds to IL-27 binds with an equilibrium dissociation constant ($K_D$) of approximately less than 100 nM ($10^{-7}$ M), optionally approximately less than 50 nM ($5 \times 10^{-8}$ M), optionally approximately less than 15 nM ($1.5 \times 10^{-8}$ M), optionally approximately less than 10 nM ($10^{-8}$ M), optionally approximately less than 5 nM ($5 \times 10^{-9}$M), optionally approximately less than 1 nM ($10^{-9}$M), optionally approximately less than 0.1 nM ($10^{-10}$ M), optionally approximately less than 0.01 nM ($10^{-11}$ M), or even lower, when determined by surface plasmon resonance (SPR) technology in a BIACORE 2000 instrument using recombinant human IL-27 as the analyte and the antibody as the ligand, where binding to the predetermined antigen occurs with an affinity that is at least two-fold greater than the antibody's affinity for binding to a non-specific antigen (e.g., BSA, casein) other than the predetermined antigen or a closely-related antigen The phrases "an antibody recognizing an antigen" and "an antibody specific for an antigen" are used interchangeably herein with the term "an antibody which binds specifically to an antigen."

As used herein, the term "STAT1 phosphorylation" refers to the phosphorylation of the Signal Transducer and Activator of Transcription 1 (STAT1) polypeptide, a transcription factor encoded by the STAT1 gene in humans. STAT molecules are phosphorylated by receptor associated kinases that cause activation and dimerization by forming homo- or heterodimers which translocate to the nucleus to work as transcription factors. STAT1 can be activated (i.e., phosphorylated) in response to signaling via several ligands, including IL-27. IL-27 signaling through the IL-27R results in phosphorylation of STAT1 (pSTAT1). STAT1 has a key role in gene expression involved in survival of the cell, viability or pathogen response. Methods to determine STAT1 phosphorylation as a result of IL-27 signaling include, but are not limited to, flow cytometric analysis of cells labeled with antibodies that specifically recognize phosphorylated STAT1 (see e.g., Tochizawa et al., (2006) J Immunol Methods 313(1-2):29-37).

As used herein, the term "STAT3 phosphorylation" refers to the phosphorylation of the Signal Transducer and Activator of Transcription 3 (STAT3) polypeptide, a transcription factor encoded by the STAT3 gene in humans. STAT3 mediates the expression of a variety of genes in response to cell stimuli, and thus plays a key role in many cellular processes such as cell growth and apoptosis. Methods to determine STAT3 phosphorylation as a result of IL-27 signaling include, but are not limited to, analysis of cells or cell extracts labeled with antibodies that specifically recognize phosphorylated STAT3 (see e.g., Fursov et al., (2011) Assay Drug Dev Technol 9(4):420-429).

As used herein, the term "switch sequence" refers to those DNA sequences responsible for switch recombination. A "switch donor" sequence, typically a μ switch region, will be 5' (i.e., upstream) of the construct region to be deleted during the switch recombination. The "switch acceptor" region will be between the construct region to be deleted and the replacement constant region (e.g., γ, ε, etc.). As there is no specific site where recombination always occurs, the final gene sequence will typically not be predictable from the construct.

As used herein, the term "subject" includes any human or non-human animal. For example, the methods and compositions of the present invention can be used to treat a subject with an immune disorder. The term "non-human animal" includes all vertebrates, e.g., mammals and non-mammals, such as non-human primates, sheep, dog, cow, chickens, amphibians, reptiles, etc.

For nucleic acids, the term "substantial homology" indicates that two nucleic acids, or designated sequences thereof, when optimally aligned and compared, are identical, with appropriate nucleotide insertions or deletions, in at least about 80% of the nucleotides, usually at least about 90% to 95%, and more preferably at least about 98% to 99.5% of the nucleotides. Alternatively, substantial homology exists when the segments will hybridize under selective hybridization conditions, to the complement of the strand.

The percent identity between two sequences is a function of the number of identical positions shared by the sequences (i.e., % homology=# of identical positions/total # of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two nucleotide sequences can be determined using the GAP program in the GCG software package (available at http://www.gcg.com), using a NWSgapdna.CMP matrix and a gap weight of 40, 50, 60, 70, or 80 and a length weight of 1, 2, 3, 4, 5, or 6. The percent identity between two nucleotide or amino acid sequences can also be determined using the algorithm of E. Meyers and W. Miller (CABIOS, 4:11-17 (1989)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (J. Mol. Biol. (48):444-453 (1970)) algorithm which has been incorporated into the GAP program in the GCG software package (available at http://www.gcg.com), using either a Blossum 62 matrix or a PAM250 matrix, and a gap weight of 16, 14, 12, 10, 8, 6, or 4 and a length weight of 1, 2, 3, 4, 5, or 6.

The nucleic acid and protein sequences of the present disclosure can further be used as a "query sequence" to perform a search against public databases to, for example, identify related sequences. Such searches can be performed using the NBLAST and XBLAST programs (version 2.0) of Altschul, et al. (1990) J. Mol. Biol. 215:403-10. BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the protein molecules of the invention. To obtain gapped alignments for comparison purposes, Gapped BLAST can be utilized as described in Altschul et al., (1997) Nucleic Acids Res. 25(17):3389-3402. When utilizing BLAST and Gapped BLAST programs, the default parameters of the respective programs (e.g., XBLAST and NBLAST) can be used. See http://www.ncbi.nlm.nih.gov.

The nucleic acids may be present in whole cells, in a cell lysate, or in a partially purified or substantially pure form. A nucleic acid is "isolated" or "rendered substantially pure" when purified away from other cellular components or other contaminants, e.g., other cellular nucleic acids or proteins, by standard techniques, including alkaline/SDS treatment, CsCl banding, column chromatography, agarose gel electrophoresis and others well known in the art. See, F. Ausubel, et al., ed. Current Protocols in Molecular Biology, Greene Publishing and Wiley Interscience, New York (1987).

The nucleic acid compositions of the present disclosure, while often in a native sequence (except for modified restriction sites and the like), from either cDNA, genomic or mixtures thereof may be mutated, in accordance with standard techniques to provide gene sequences. For coding sequences, these mutations, may affect amino acid sequence as desired. In particular, DNA sequences substantially homologous to or derived from native V, D, J, constant, switches and other such sequences described herein are contemplated (where "derived" indicates that a sequence is identical or modified from another sequence).

As used herein, the term "STING" (alternatively TMEM173) refers to the Stimulator of Interferon Genes, a protein that functions both as a direct cytosolic DNA sensor and as an adaptor protein. In humans, STING is encoded by the TMEM173 gene. STING plays an important role in innate immunity. STING induces type I interferon production when cells are infected with intracellular pathogens, such as viruses, mycobacteria and intracellular parasites. Type I interferon, mediated by STING, protects infected cells and nearby cells from local infection by binding to the same cell that secretes it and nearby cells. An exemplary amino acid sequence for STING is provided by the NCBI Genbank database under the accession number NP_001288667.

The term "T cell" refers to a type of white blood cell that can be distinguished from other white blood cells by the presence of a T cell receptor on the cell surface. There are several subsets of T cells, including, but not limited to, T helper cells (a.k.a. Tx cells or CD4+ T cells) and subtypes, including $T_H1$, $T_H2$, $T_H3$, $T_H17$, $T_H9$, and $T_{FH}$ cells, cytotoxic T cells (a.k.a Tc cells, CD8+ T cells, cytotoxic T lymphocytes, T-killer cells, killer T cells), memory T cells and subtypes, including central memory T cells ($T_{CM}$ cells), effector memory T cells ($T_{EM}$ and $T_{EMRA}$ cells), and resident memory T cells ($T_{RM}$ cells), regulatory T cells (a.k.a. $T_{reg}$ cells or suppressor T cells) and subtypes, including CD4+ FOXP3+ $T_{reg}$ cells, CD4+ FOXP3- $T_{reg}$ cells, Tr1 cells, Th3 cells, and $T_{reg}17$ cells, natural killer T cells (a.k.a. NKT cells), mucosal associated invariant T cells (MAITs), and gamma delta T cells (γδ T cells), including Vγ9/Vδ2 T cells. Any one or more of the aforementioned or unmentioned T cells may be the target cell type for a method of use of the invention.

As used herein, the term "T cell-mediated response" refers to any response mediated by T cells, including, but not limited to, effector T cells (e.g., CD8+ cells) and helper T cells (e.g., CD4+ cells). T cell mediated responses include, for example, T cell cytotoxicity and proliferation.

As used herein, the terms "therapeutically effective amount" or "therapeutically effective dose," or similar terms used herein are intended to mean an amount of an agent (e.g., an anti-IL-27 antibody or an antigen-binding fragment thereof) that will elicit the desired biological or medical response (e.g., an improvement in one or more symptoms of a cancer).

As used herein, the term "TAM receptor" refers to the TAM receptor protein tyrosine kinases (TYRO3, AXL and MER). TAM receptors are involved in the regulation of immune system homeostasis. In a cancer setting, TAM receptors have a dual regulatory role, controlling the initiation and progression of tumor development and, at the same time, the associated anti-tumor responses of diverse immune cells. Further description of TAM receptors is found in Paolino and Penninger (2016) Cancers 8(97): doi:10.3390/cancers8100097). As used herein, the term "TAM receptor inhibitor" or "TAM inhibitor" refers to an agent that inhibits, blocks or reduces the function or activity of a TAM receptor.

As used herein, the term "TIGIT" or "T-cell immunoreceptor with Ig and ITIM domains" refers to any native TIGIT from any vertebrate source, including mammals such as primates (e.g., humans) and rodents (e.g., mice and rats), unless otherwise indicated. TIGIT is also known in the art as DKFZp667A205, FLJ39873, V-set and immunoglobulin domain-containing protein 9, V-set and transmembrane domain-containing protein 3, VSIG9, VSTM3, and WUCAM. The term also encompasses naturally occurring variants of TIGIT, e.g., splice variants or allelic variants. The amino acid sequence of an exemplary human TIGIT may be found under UniProt Accession Number Q495A1.

The terms "treat," "treating," and "treatment," as used herein, refer to therapeutic or preventative measures described herein. The methods of "treatment" employ administration to a subject, in need of such treatment, a human antibody of the present disclosure, for example, a subject in need of an enhanced immune response against a particular antigen or a subject who ultimately may acquire such a disorder, in order to prevent, cure, delay, reduce the severity of, or ameliorate one or more symptoms of the disorder or recurring disorder, or in order to prolong the survival of a subject beyond that expected in the absence of such treatment.

As used herein, the term "tumor microenvironment" (alternatively "cancer microenvironment"; abbreviated TME) refers to the cellular environment or milieu in which the tumor or neoplasm exists, including surrounding blood vessels as well as non-cancerous cells including, but not limited to, immune cells, fibroblasts, bone marrow-derived inflammatory cells, and lymphocytes. Signaling molecules and the extracellular matrix also comprise the TME. The tumor and the surrounding microenvironment are closely related and interact constantly. Tumors can influence the microenvironment by releasing extracellular signals, promoting tumor angiogenesis and inducing peripheral immune tolerance, while the immune cells in the microenvironment can affect the growth and evolution of tumor cells.

As used herein, the term "unrearranged" or "germline configuration" refers to the configuration wherein the V segment is not recombined so as to be immediately adjacent to a D or J segment.

As used herein, the term "vector" is intended to refer to a nucleic acid molecule capable of transporting another nucleic acid to which it has been linked. One type of vector is a "plasmid," which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "expression vectors"). In general, expression vectors of utility in recombinant DNA techniques are often in the form of plasmids. In the present specification, "plasmid" and "vector" may be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

Unless otherwise defined, all technical and scientific terms used herein have the same meaning as commonly understood by one of ordinary skill in the art to which this disclosure pertains. Preferred methods and materials are described below, although methods and materials similar or equivalent to those described herein can also be used in the practice or testing of the presently disclosed methods and compositions. All publications, patent applications, patents, and other references mentioned herein are incorporated by reference in their entirety.

BRIEF DESCRIPTION OF THE DRAWINGS

FIG. 1 is a table that provides affinity data for anti-IL-27 antibodies, as indicated. Affinity measurements were performed using ForteBio and Meso Scale Discovery methods.

FIG. 3A is a graph depicting the inhibition of IL-27-mediated phosphorylation of STAT1 in human whole blood by anti-IL-27 antibodies, as indicated, as measured by flow cytometry. FIG. 3B is a graph depicting the inhibition of IL-27-mediated phosphorylation of STAT1 in human PBMCs by anti-IL-27 antibodies, as indicated, as measured by flow cytometry. FIG. 3C is a graph depicting the inhibition of IL-27-mediated phosphorylation of STAT1 in U937 cells by anti-IL-27 antibodies, as indicated, as measured by flow cytometry. FIG. 3D is a graph depicting the inhibition of IL-27-mediated phosphorylation of STAT1 in HUT-78 cells by anti-IL-27 antibodies, as indicated, as measured by flow cytometry. FIG. 3E is graph showing that SRF388 inhibits IL-27-mediated pSTAT1 in human whole blood T cells.

FIG. 9 presents a tabulated summary of select monoclonal antibody properties.

FIG. 10A presents a chart of antibody sequences, with sequence partitioning reflecting NT numbering. FIG. 10B presents a chart of antibody sequences (corresponding to the sequence chart of FIG. 10A), with sequence partitioning reflecting ImMunoGeneTics (IMGT) numbering. In both FIG. 10A and FIG. 10B, highlighted amino acids in CDR sequences show mutations from germline-encoded sequence. As will be apparent to the skilled artisan, antibody numbering, including determination of CDR sequences, framework sequences, etc., can be performed in a number of art-recognized manners, including via the NT and IMGT numbering systems presented in FIG. 10A and FIG. 10B and employed elsewhere herein.

DETAILED DESCRIPTION

Figure 2:
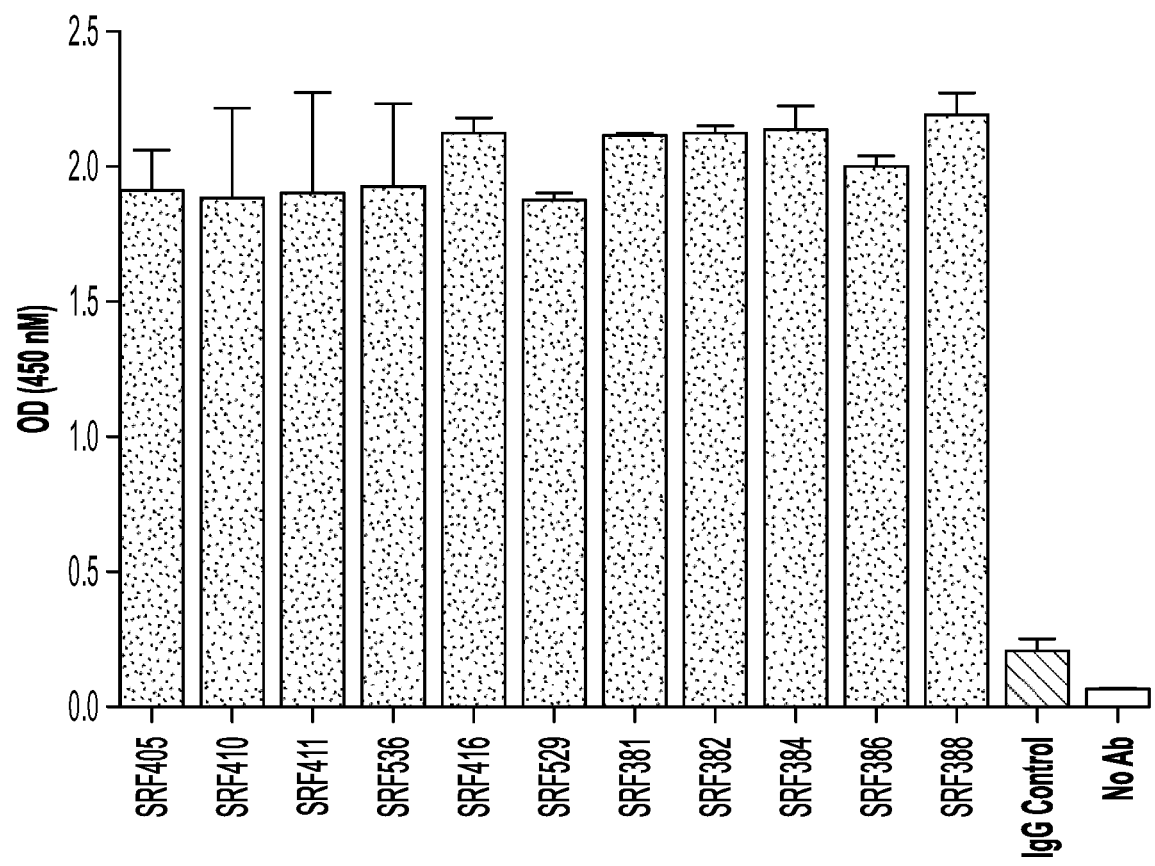
FIG. 2 is a graph depicting the binding of anti-IL-27 antibodies, as indicated, to plate-bound recombinant IL-27 as measured by ELISA.

The present disclosure provides, at least in part, antibody molecules that bind to human IL-27 with high affinity and specificity. In one embodiment, disclosed herein are human antibodies that bind to IL-27. The terms "IL-27" and "IL27" as used herein refer interchangeably to the heterodimeric cytokine, IL-27 that is composed of two distinct subunits, encoded by two different genes: Epstein-Barr virus-induced gene 3 (EBI3) and IL-27p28. IL-27 has both pro- and anti-inflammatory properties with diverse effects on—hematopoietic and non-hematopoietic cells.

Accordingly, in one aspect, the disclosure provides a monoclonal antibody that specifically binds to and antagonizes human IL-27, or an antigen binding portion thereof, wherein the antibody or antigen binding portion thereof exhibits at least one or more of the following properties:
(i) binds to human IL-27 with an equilibrium dissociation constant ($K_D$) of 15 nM or less;
(ii) blocks binding of IL-27 to IL-27 receptor;
(iii) inhibits or reduces STAT1 and/or STAT3 phosphorylation in a cell;
(iv) inhibits or reduces IL-27 mediated inhibition of CD161 expression in a cell;
(v) inhibits or reduces IL-27 mediated PD-L1 and/or TIM-3 expression in a cell;
(vi) induces or enhances PD-1 mediated secretion of one or more cytokines from a cell; and
(vii) a combination of (i)-(vi).

In other aspects, the disclosure provides a monoclonal antibody or antigen binding portion thereof that specifically binds human IL-27 and inhibits or reduces an IL-27 biological activity or IL-27 signaling.

Additional aspects of the invention include nucleic acid molecules encoding the antibody molecules, expression vectors, host cells and methods for making the antibody molecules. Immunoconjugates, multi- or bispecific molecules and pharmaceutical compositions comprising the antibody molecules are also provided. The anti-IL-27 antibody molecules disclosed herein can be used to treat, prevent and/or diagnose cancerous or malignant disorders, e.g., solid and liquid tumors (e.g., leukemia, e.g., lymphoma, e.g., AML), lung cancer (e.g., non-small cell lung cancer), pancreatic cancer, breast cancer (e.g., triple-negative breast cancer), melanoma, testicular cancer, sarcoma, head and neck cancer (e.g., squamous head and neck cancer), liver cancer (e.g., hepatocellular carcinoma (HCC)), colorectal cancer, ovarian cancer, brain cancer (e.g., glioblastoma multiforme), or renal cancer (e.g., renal cell cancer, e.g. renal clear cell carcinoma).

Anti-IL-27 Antibodies and Antigen-Binding Fragments Thereof

The present disclosure provides antibodies, and antigen binding portions thereof, that specifically bind to and antagonize IL-27, in particular human IL-27. Provided herein are isolated monoclonal antibodies or antigen binding portion thereof that specifically bind to human IL-27, comprising heavy and light chain CDRs and variable sequences as set forth in Table 12.

In some embodiments, the disclosure provides an isolated monoclonal antibody that specifically binds to and antagonizes human IL-27, or an antigen binding portion thereof, wherein the antibody or antigen binding portion thereof exhibits at least one or more of the following properties: (i) binds to human IL-27 with an equilibrium dissociation constant ($K_D$) of 15 nM or less; (ii) blocks binding of IL-27 to IL-27 receptor; (iii) inhibits or reduces STAT1 and/or STAT3 phosphorylation in a cell; (iv) inhibits or reduces inhibition of CD161 expression in a cell; (v) inhibits or reduces PD-L1 and/or TIM-3 expression in a cell; (vi) induces or enhances PD-1 mediated secretion of one or more cytokines from a cell; and (vii) a combination of (i)-(vi).

In some embodiments, the isolated monoclonal antibody, or antigen binding portion thereof, binds to human IL-27 with an equilibrium dissociation constant ($K_D$) of 15 nM or less.

In some embodiments, the isolated monoclonal antibody, or antigen binding portion thereof, binds to recombinant human IL-27 or to murine IL-27.

In some embodiments, the isolated monoclonal antibody, or antigen binding portion thereof, inhibits or reduces STAT1 and/or STAT3 phosphorylation in a cell. In some embodiments, the cell is an immune cell. In some embodiments, the cell is a cancer cell.

In some embodiments, the isolated monoclonal antibody, or antigen binding portion thereof, inhibits or reduces inhibition of CD161 expression in a cell (e.g. ameliorates or relieves the inhibition of CD161 expression in a cell). In some embodiments, the cell is an immune cell.

In some embodiments, the isolated monoclonal antibody, or antigen binding portion thereof, inhibits or reduces PD-L1 and/or TIM-3 expression in a cell. In some embodiments, PD-L1 expression is inhibited or reduced. In some embodiments, TIM-3 expression is inhibited or reduced. In some embodiments, both PD-L1 expression and TIM-3 expression is reduced. In some embodiments, the cell is an immune cell.

In some embodiments, the isolated monoclonal antibody, or antigen binding portion thereof, induces or enhances the PD-1-mediated secretion of one or more cytokines from a cell. In some embodiments, the one or more cytokines is TNFα. In some embodiments, the one or more cytokine is IL-6. In some embodiments, the one or more cytokine is TNFα and IL-6. In some embodiments, the cell is an immune cell.

In some embodiments, the isolated monoclonal antibody, or antigen binding portion thereof, is selected from the group consisting of an IgG1, an IgG2, an IgG3, an IgG4, an IgM, an IgA1 an IgA2, an IgD, and an IgE antibody. In some embodiments, the antibody is an IgG1 antibody or an IgG4 antibody. In some embodiments, the antibody comprises a wild type IgG1 heavy chain constant region. In some embodiments, the antibody comprises a wild type IgG4 heavy chain constant region. In some embodiments, the antibody comprises an Fc domain comprising at least one mutation. In some embodiments, the antibody comprises a mutant IgG1 heavy chain constant region. In some embodiments, the antibody comprises a mutant IgG4 heavy chain constant region. In some embodiments, the mutant IgG4 heavy chain constant region comprises any one of the substitutions S228P, L235E, L235A, or a combination thereof, according to EU numbering.

In some embodiments, the disclosure provides an isolated monoclonal antibody, or antigen binding portion thereof, that binds to substantially the same epitope on IL-27 as the antibody, or antigen binding portion thereof, according to any one of the aforementioned embodiments.

In some embodiments, the disclosure provides an isolated monoclonal antibody, or antigen binding portion thereof, that binds to at least one of the amino acid residues comprising IL-27 bound by the antibody, or antigen binding portion thereof, according to any one of the aforementioned embodiments.

In some embodiments, the disclosure provides an isolated monoclonal antibody, or antigen binding portion thereof, wherein a mutation of the epitope on IL-27 bound by the antibody or antigen binding portion thereof inhibits, reduces, or blocks binding to both the antibody or antigen binding portion thereof and to the antibody or antigen binding portion thereof according to any one of the aforementioned embodiments.

In some embodiments, the disclosure provides an isolated monoclonal antibody, or antigen binding portion thereof, that binds to an epitope on IL-27, wherein the epitope is the same or is similar to the epitope bound by an antibody molecule described in Table 12.

In some embodiments, the disclosure provides an isolated monoclonal antibody that specifically binds to and antagonizes human IL-27, or antigen binding portion thereof, wherein the antibody or antigen binding portion thereof comprises heavy and light chain CDRs selected from the group consisting of:
(i) heavy chain CDR1, CDR2 and CDR3 sequences set forth in SEQ ID NOs: 706, 707 and 708, respectively, and light chain CDR1, CDR2 and CDR3 sequences set forth in SEQ ID NOs: 714, 715 and 716, respectively;
(ii) heavy chain CDR1, CDR2 and CDR3 sequences set forth in SEQ ID NOs: 728, 729 and 730, respectively, and light chain CDR1, CDR2 and CDR3 sequences set forth in SEQ ID NOs: 736, 737 and 738, respectively;
(iii) heavy chain CDR1, CDR2 and CDR3 sequences set forth in SEQ ID NOs: 750, 751 and 752, respectively, and light chain CDR1, CDR2 and CDR3 sequences set forth in SEQ ID NOs: 758, 759 and 760, respectively; and
(iv) heavy chain CDR1, CDR2 and CDR3 sequences set forth in SEQ ID NOs: 750, 751 and 752, respectively, and light chain CDR1, CDR2 and CDR3 sequences set forth in SEQ ID NOs: 758, 759 and 760, respectively; and.

In some embodiments, the disclosure provides an isolated monoclonal antibody that specifically binds to and antagonizes human IL-27, or antigen binding portion thereof, wherein the antibody or antigen binding portion thereof comprises heavy and light chain CDRs, wherein the heavy chain CDR1, CDR2 and CDR3 sequences are set forth in SEQ ID NOs: 161, 162 and 163, respectively, and the light chain CDR1, CDR2 and CDR3 sequences are set forth in SEQ ID NOs: 169, 170 and 171, respectively.

In some embodiments, the disclosure provides an isolated monoclonal antibody that specifically binds to and antagonizes human IL-27, or antigen binding portion thereof, wherein the antibody or antigen binding portion thereof comprises heavy and light chain CDRs selected from the group consisting of:
(i) heavy chain CDR1, CDR2 and CDR3 sequences set forth in SEQ ID NOs: 709, 710 and 711, respectively, and light chain CDR1, CDR2 and CDR3 sequences set forth in SEQ ID NOs: 717, 718 and 719, respectively;
(ii) heavy chain CDR1, CDR2 and CDR3 sequences set forth in SEQ ID NOs: 731, 732 and 733, respectively, and light chain CDR1, CDR2 and CDR3 sequences set forth in SEQ ID NOs: 739, 740 and 741, respectively;
(iii) heavy chain CDR1, CDR2 and CDR3 sequences set forth in SEQ ID NOs: 753, 754 and 755, respectively, and light chain CDR1, CDR2 and CDR3 sequences set forth in SEQ ID NOs: 761, 762 and 763, respectively; and
(iv) heavy chain CDR1, CDR2 and CDR3 sequences set forth in SEQ ID NOs: 775, 776 and 777, respectively, and light chain CDR1, CDR2 and CDR3 sequences set forth in SEQ ID NOs: 783, 784 and 785, respectively.

In some embodiments, the disclosure provides an isolated monoclonal antibody that specifically binds to and antagonizes human IL-27, or antigen binding portion thereof, wherein the antibody or antigen binding portion thereof comprises heavy and light chain CDRs, wherein the heavy chain CDR1, CDR2 and CDR3 sequences are set forth in SEQ ID NOs: 164, 165 and 166, respectively, and the light chain CDR1, CDR2 and CDR3 sequences are set forth in SEQ ID NOs: 172, 173 and 174, respectively.

In some embodiments, the disclosure provides an isolated monoclonal antibody that specifically binds to and antagonizes human IL-27, or antigen binding portion thereof, wherein the antibody or antigen binding portion thereof comprises heavy and light chain CDRs, wherein the amino acid sequences of heavy chain CDR1, CDR2 and CDR3 are SYSMS (SEQ ID NO: 23), YISYDGGSAYYPDTVKG (SEQ ID NO: 24) and HGDYDDDDAMDY (SEQ ID NO: 25), respectively, and wherein the amino acid sequences of light chain CDR1, CDR2 and CDR3 are RASENIYSYLA (SEQ ID NO: 26), NAETLTE (SEQ ID NO: 27) and QHHYGTPLT (SEQ ID NO: 28), respectively.

In some embodiments, the disclosure provides an isolated monoclonal antibody that specifically binds to and antagonizes human IL-27, or antigen binding portion thereof, wherein the antibody or antigen binding portion thereof comprises heavy and light chain variable regions, wherein the heavy chain variable region comprises an amino acid sequence selected from the group consisting of SEQ ID NOs: 712, 734, 756 and 778; and wherein the light chain variable region comprises an amino acid sequence selected from the group consisting of SEQ ID NOs: 720, 742, 764 and 786.

In some embodiments, the disclosure provides an isolated monoclonal antibody that specifically binds to and antagonizes human IL-27, or antigen binding portion thereof, wherein the antibody or antigen binding portion thereof comprises heavy and light chain variable regions comprising amino acid sequences selected from the group consisting of:
  (i) SEQ ID NO: 712 and 720, respectively;
  (ii) SEQ ID NO: 734 and 742, respectively;
  (iii) SEQ ID NO: 756 and 764, respectively; and
  (iv) SEQ ID NO: 778 and 786, respectively.

In some embodiments, the disclosure provides an isolated monoclonal antibody that specifically binds to and antagonizes human IL-27, or antigen binding portion thereof, wherein the antibody or antigen binding portion thereof comprises heavy and light chain variable regions, wherein the heavy chain variable region comprises an amino acid sequence which is at least 90% identical to the amino acid sequence selected from the group consisting of SEQ ID NOs: 712, 734, 756 and 778; and wherein the light chain variable region comprises an amino acid sequence which is at least 90% identical to the amino acid sequence selected from the group consisting of SEQ ID NOs: 720, 742, 764 and 786.

In some embodiments, the disclosure provides an isolated monoclonal antibody that specifically binds to and antagonizes human IL-27, or antigen binding portion thereof, wherein the antibody or antigen binding portion thereof comprises heavy and light chain variable regions comprising amino acid sequences at least 90% identical to the amino acid sequences selected from the group consisting of:
  (i) SEQ ID NO: 712 and 720, respectively;
  (ii) SEQ ID NO: 734 and 742, respectively;
  (iii) SEQ ID NO: 756 and 764, respectively; and
  (iv) SEQ ID NO: 778 and 786, respectively.

In some embodiments, the disclosure provides an isolated monoclonal antibody that specifically binds to and antagonizes human IL-27, or antigen binding portion thereof, wherein the antibody or antigen binding portion thereof comprises heavy and light chain variable regions comprising amino acid sequences set forth in SEQ ID NO: 167 and 175, respectively.

In some embodiments, the disclosure provides an isolated monoclonal antibody that specifically binds to and antagonizes human IL-27, or antigen binding portion thereof, wherein the antibody or antigen binding portion thereof comprises heavy and light chain variable regions comprising amino acid sequences at least 90% identical to the amino acid sequences set forth in SEQ ID NO: 167 and 175, respectively.

In some embodiments, the disclosure provides an isolated monoclonal antibody that specifically binds to and antagonizes human IL-27, or antigen binding portion thereof, wherein the antibody or antigen binding portion thereof comprises a heavy chain and a light chain, wherein the heavy chain comprises an amino acid sequence selected from the group consisting of SEQ ID NOs: 722, 744, 766 and 788; and wherein the light chain comprises an amino acid sequence selected from the group consisting of SEQ ID NOs: 724, 746, 768 and 790.

In some embodiments, the disclosure provides an isolated monoclonal antibody that specifically binds to and antagonizes human IL-27, or antigen binding portion thereof, wherein the antibody or antigen binding portion thereof comprises a heavy and a light chain, wherein the heavy chain comprises an amino acid sequence which is at least 90% identical to the amino acid sequence selected from the group consisting of SEQ ID NOs: 722, 744, 766 and 788; and wherein the light chain comprises an amino acid sequence which is at least 90% identical to the amino acid sequence selected from the group consisting of SEQ ID NOs: 724, 746, 768 and 790.

In some embodiments, the disclosure provides an isolated monoclonal antibody that specifically binds to and antagonizes human IL-27, or antigen binding portion thereof, wherein the antibody or antigen binding portion thereof comprises a heavy chain and a light chain, wherein the heavy chain comprises an amino acid sequence selected from the group consisting of SEQ ID NOs: 726, 748, 770 and 792; and wherein the light chain comprises an amino acid sequence selected from the group consisting of SEQ ID NOs: 724, 746, 768 and 790.

In some embodiments, the disclosure provides an isolated monoclonal antibody that specifically binds to and antagonizes human IL-27, or antigen binding portion thereof, wherein the antibody or antigen binding portion thereof comprises a heavy and a light chain, wherein the heavy chain comprises an amino acid sequence which is at least 90% identical to the amino acid sequence selected from the group consisting of SEQ ID NOs: 726, 748, 770 and 792; and wherein the light chain comprises an amino acid sequence which is at least 90% identical to the amino acid sequence selected from the group consisting of SEQ ID NOs: 724, 746, 768 and 790.

In some embodiments, the disclosure provides an isolated monoclonal antibody that specifically binds to and antagonizes human IL-27, or antigen binding portion thereof, wherein the antibody or antigen binding portion thereof comprises a heavy chain and a light chain comprising amino acid sequences selected from the group consisting of:
  (i) SEQ ID NO: 722 and 724, respectively;
  (ii) SEQ ID NO: 744 and 746, respectively;
  (iii) SEQ ID NO: 766 and 768, respectively; and
  (iv) SEQ ID NO: 788 and 790, respectively.

In some embodiments, the disclosure provides an isolated monoclonal antibody that specifically binds to and antagonizes human IL-27, or antigen binding portion thereof, wherein the antibody or antigen binding portion thereof comprises a heavy chain and a light chain comprising amino acid sequences at least 90% identical to the amino acid sequences selected from the group consisting of:
  (i) SEQ ID NO: 722 and 724, respectively;
  (ii) SEQ ID NO: 744 and 746, respectively;
  (iii) SEQ ID NO: 766 and 768, respectively; and
  (iv) SEQ ID NO: 788 and 790, respectively.

In some embodiments, the disclosure provides an isolated monoclonal antibody that specifically binds to and antagonizes human IL-27, or antigen binding portion thereof, wherein the antibody or antigen binding portion thereof comprises a heavy and a light chain comprising amino acid sequences selected from the group consisting of:
(i) SEQ ID NO: 726 and 724, respectively;
(ii) SEQ ID NO: 748 and 746, respectively;
(iii) SEQ ID NO: 770 and 768, respectively; and
(iv) SEQ ID NO: 792 and 790, respectively.

In some embodiments, the disclosure provides an isolated monoclonal antibody that specifically binds to and antagonizes human IL-27, or antigen binding portion thereof, wherein the antibody or antigen binding portion thereof comprises a heavy and a light chain comprising amino acid sequences at least 90% identical to the amino acid sequences selected from the group consisting of:
(i) SEQ ID NO: 726 and 724, respectively;
(ii) SEQ ID NO: 748 and 746, respectively;
(iii) SEQ ID NO: 770 and 768, respectively; and
(iv) SEQ ID NO: 792 and 790, respectively.

In some embodiments, the disclosure provides an isolated monoclonal antibody that specifically binds to and antagonizes human IL-27, or antigen binding portion thereof, wherein the antibody or antigen binding portion thereof comprises a heavy chain and a light chain comprising amino acid sequences set forth in SEQ ID NO: 177 and 179, respectively.

In some embodiments, the disclosure provides an isolated monoclonal antibody that specifically binds to and antagonizes human IL-27, or antigen binding portion thereof, wherein the antibody or antigen binding portion thereof comprises a heavy chain and a light chain comprising amino acid sequences at least 90% identical to the amino acid sequences set forth in SEQ ID NO: 177 and 179, respectively.

In some embodiments, the disclosure provides an isolated monoclonal antibody that specifically binds to and antagonizes human IL-27, or antigen binding portion thereof, wherein the antibody or antigen binding portion thereof comprises a heavy and a light chain comprising amino acid sequences set forth in SEQ ID NO: 181 and 179, respectively.

In some embodiments, the disclosure provides an isolated monoclonal antibody that specifically binds to and antagonizes human IL-27, or antigen binding portion thereof, wherein the antibody or antigen binding portion thereof comprises a heavy chain and a light chain comprising amino acid sequences at least 90% identical to the amino acid sequences set forth in SEQ ID NO: 181 and 179, respectively.

Anti-IL-27 Receptor (WSX-1) Antibodies and Antigen-Binding Fragments Thereof

WSX-1 is a class I cytokine receptor that is homologous to the β2 chain of the IL-12R in both sequence and structure. This receptor is highly expressed by resting/naive CD4$^+$ T cells and CD8$^+$ T cells. Recent studies have identified IL-27, heterodimeric cytokine composed of the subunits EBI3 and IL-27p28, as the ligand for WSX-1. EBI3, a member of the class I cytokine receptor family, shares significant structural homology to IL-12p40, and IL-27p28 is closely related to IL-12p35. In addition to the structural similarity between the IL-12/IL-12R and IL-27/WSX-1 ligand/receptor pairs, there are also reports that show functional similarity. While the IL-12R plays a critical role in the development of Th1 type responses, it has been reported that WSX-1 deficient cells have impaired IFN-γ production during early Th1 differentiation. Moreover, recombinant IL-27, like IL-12, can enhance Th1 differentiation in highly purified naive helper T cells. As a consequence of these studies, an early consensus emerged that IL-27/WSX-1 was, like the IL-12/IL-12R interaction, an important factor in the initial differentiation of Th1 responses.

Accordingly, in some embodiments, the disclosure provides an isolated monoclonal antibody that specifically binds to and antagonizes human WSX-1, or antigen binding portion thereof, wherein the antibody or antigen binding portion thereof comprises heavy and light chain CDRs, wherein the heavy chain CDR1, CDR2 and CDR3 amino acid sequences are SNNAAWN (SEQ ID NO: 802), RTYYRSKWYNDYALSVKS (SEQ ID NO: 803) and GLPMVPFDS (SEQ ID NO: 804), respectively, and the light chain CDR1, CDR2 and CDR3 sequences are RASQSISSWLA (SEQ ID NO: 805), KASSLES (SEQ ID NO: 806) and QQYDSFSMYT (SEQ ID NO: 807), respectively.

In some embodiments, the disclosure provides an isolated monoclonal antibody that specifically binds to and antagonizes human WSX-1, or antigen binding portion thereof, wherein the antibody or antigen binding portion thereof comprises heavy and light chain variable regions, wherein the heavy chain variable region comprises the amino acid sequence set forth in SEQ ID NOs: 794; and wherein the light chain variable region comprises the amino acid sequence set forth in SEQ ID NOs: 796.

In some embodiments, the antibody that specifically binds to and antagonizes human WSX-1, or antigen binding portion thereof, comprises a light chain constant region, wherein the light chain constant region comprises the amino acid sequence set forth in SEQ ID NO: 798.

In some embodiments, the antibody that specifically binds to and antagonizes human WSX-1, or antigen binding portion thereof comprises a heavy chain constant region, wherein the heavy chain constant region comprises the amino acid sequence set forth in SEQ ID NO: 799.

Methods for Producing the Anti-IL-27 Antibodies and Antigen-Binding Fragments Thereof The disclosure also features methods for producing any of the anti-IL-27 antibodies or antigen-binding fragments thereof described herein. In some embodiments, methods for preparing an antibody described herein can include immunizing a subject (e.g., a non-human mammal) with an appropriate immunogen. Suitable immunogens for generating any of the antibodies described herein are set forth herein. For example, to generate an antibody that binds to IL-27, a skilled artisan can immunize a suitable subject (e.g., a non-human mammal such as a rat, a mouse, a gerbil, a hamster, a dog, a cat, a pig, a goat, a horse, or a non-human primate) with IL-27. In some embodiments, a full-length human IL-27 EBI3 monomer polypeptide comprising the amino acid sequence set forth in SEQ ID NO: 97 is used as the immunogen. In some embodiments, a full-length human IL-27p28 monomer polypeptide comprising the amino acid sequence set forth in SEQ ID NO: 98 is used as the immunogen.

A suitable subject (e.g., a non-human mammal) can be immunized with the appropriate antigen along with subsequent booster immunizations a number of times sufficient to elicit the production of an antibody by the mammal. The immunogen can be administered to a subject (e.g., a non-human mammal) with an adjuvant. Adjuvants useful in producing an antibody in a subject include, but are not limited to, protein adjuvants; bacterial adjuvants, e.g., whole bacteria (BCG, *Corynebacterium parvum* or *Salmonella minnesota*) and bacterial components including cell wall skeleton, trehalose dimycolate, monophosphoryl lipid A, methanol extractable residue (MER) of tubercle *bacillus*, complete or incomplete Freund's adjuvant; viral adjuvants; chemical adjuvants, e.g., aluminum hydroxide, and iodoacetate and cholesteryl hemisuccinate. Other adjuvants that can be used in the methods for inducing an immune response include, e.g., cholera toxin and parapoxvirus proteins. See also Bieg et al. (1999) *Autoimmunity* 31(1):15-24. See also, e.g., Lodmell et al. (2000) *Vaccine* 18:1059-1066; Johnson et al. (1999) *J Med Chem* 42:4640-4649; Baldridge et al. (1999) *Methods* 19:103-107; and Gupta et al. (1995) *Vaccine* 13(14): 1263-1276.

In some embodiments, the methods include preparing a hybridoma cell line that secretes a monoclonal antibody that binds to the immunogen. For example, a suitable mammal such as a laboratory mouse is immunized with an IL-27 polypeptide as described above. Antibody-producing cells (e.g., B cells of the spleen) of the immunized mammal can be isolated two to four days after at least one booster immunization of the immunogen and then grown briefly in culture before fusion with cells of a suitable myeloma cell line. The cells can be fused in the presence of a fusion promoter such as, e.g., vaccinia virus or polyethylene glycol. The hybrid cells obtained in the fusion are cloned, and cell clones secreting the desired antibodies are selected. For example, spleen cells of Balb/c mice immunized with a suitable immunogen can be fused with cells of the myeloma cell line PAI or the myeloma cell line Sp2/0-Ag 14. After the fusion, the cells are expanded in suitable culture medium, which is supplemented with a selection medium, for example HAT medium, at regular intervals in order to prevent normal myeloma cells from overgrowing the desired hybridoma cells. The obtained hybrid cells are then screened for secretion of the desired antibodies, e.g., an antibody that binds to human IL-27 and In some embodiments, a skilled artisan can identify an anti-IL-27 antibody from a non-immune biased library as described in, e.g., U.S. Pat. No. 6,300,064 (to Knappik et al.; Morphosys AG) and Schoonbroodt et al. (2005) *Nucleic Acids Res* 33(9):e81.

In some embodiments, the methods described herein can involve, or be used in conjunction with, e.g., phage display technologies, bacterial display, yeast surface display, eukaryotic viral display, mammalian cell display, and cell-free (e.g., ribosomal display) antibody screening techniques (see, e.g., Etz et al. (2001) *J Bacteriol* 183:6924-6935; Cornelis (2000) *Curr Opin Biotechnol* 11:450-454; Klemm et al. (2000) *Microbiology* 146:3025-3032; Kieke et al. (1997) *Protein Eng* 10:1303-1310; Yeung et al. (2002) *Biotechnol Prog* 18:212-220; Boder et al. (2000) *Methods Enzymology* 328:430-444; Grabherr et al. (2001) *Comb Chem High Throughput Screen* 4:185-192; Michael et al. (1995) *Gene Ther* 2:660-668; Pereboev et al. (2001) *J Virol* 75:7107-7113; Schaffitzel et al. (1999) *J Immunol Methods* 231:119-135; and Hanes et al. (2000) *Nat Biotechnol* 18:1287-1292).

Methods for identifying antibodies using various phage display methods are known in the art. In phage display methods, functional antibody domains are displayed on the surface of phage particles which carry the polynucleotide sequences encoding them. Such phage can be utilized to display antigen-binding domains of antibodies, such as Fab, Fv, or disulfide-bond stabilized Fv antibody fragments, expressed from a repertoire or combinatorial antibody library (e.g., human or murine). Phage used in these methods are typically filamentous phage such as fd and M13. The antigen binding domains are expressed as a recombinantly fused protein to any of the phage coat proteins pIII, pVIII, or pIX. See, e.g., Shi et al. (2010) *JMB* 397:385-396. Examples of phage display methods that can be used to make the immunoglobulins, or fragments thereof, described herein include those disclosed in Brinkman et al. (1995) *J Immunol Methods* 182:41-50; Ames et al. (1995) *J Immunol Methods* 184:177-186; Kettleborough et al. (1994) *Eur J Immunol* 24:952-958; Persic et al. (1997) *Gene* 187:9-18; Burton et al. (1994) *Advances in Immunology* 57:191-280; and PCT publication nos. WO 90/02809, WO 91/10737, WO 92/01047, WO 92/18619, WO 93/11236, WO 95/15982, and WO 95/20401. Suitable methods are also described in, e.g., U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108.

In some embodiments, the phage display antibody libraries can be generated using mRNA collected from B cells from the immunized mammals. For example, a splenic cell sample comprising B cells can be isolated from mice immunized with IL-27 polypeptide as described above. mRNA can be isolated from the cells and converted to cDNA using standard molecular biology techniques. See, e.g., Sambrook et al. (1989) "Molecular Cloning: A Laboratory Manual, $2^{nd}$ Edition," Cold Spring Harbor Laboratory Press, Cold Spring Harbor, N.Y.; Harlow and Lane (1988), supra; Benny K. C. Lo (2004), supra; and Borrebaek (1995), supra. The cDNA coding for the variable regions of the heavy chain and light chain polypeptides of immunoglobulins are used to construct the phage display library. Methods for generating such a library are described in, e.g., Merz et al. (1995) *J Neurosci Methods* 62(1-2):213-9; Di Niro et al. (2005) *Biochem J* 388(Pt 3):889-894; and Engberg et al. (1995) *Methods Mol Biol* 51:355-376.

In some embodiments, a combination of selection and screening can be employed to identify an antibody of interest from, e.g., a population of hybridoma-derived antibodies or a phage display antibody library. Suitable methods are known in the art and are described in, e.g., Hoogenboom (1997) *Trends in Biotechnology* 15:62-70; Brinkman et al. (1995), supra; Ames et al. (1995), supra; Kettleborough et al. (1994), supra; Persic et al. (1997), supra; and Burton et al. (1994), supra. For example, a plurality of phagemid vectors, each encoding a fusion protein of a bacteriophage coat protein (e.g., pIII, pVIII, or pIX of M13 phage) and a different antigen-combining region are produced using standard molecular biology techniques and then introduced into a population of bacteria (e.g., *E. coli*). Expression of the bacteriophage in bacteria can, in some embodiments, require use of a helper phage. In some embodiments, no helper phage is required (see, e.g., Chasteen et al., (2006) *Nucleic Acids Res* 34(21):e145). Phage produced from the bacteria are recovered and then contacted to, e.g., a target antigen bound to a solid support (immobilized). Phage may also be contacted to antigen in solution, and the complex is subsequently bound to a solid support.

A subpopulation of antibodies screened using the above methods can be characterized for their specificity and binding affinity for a particular antigen (e.g., human IL-27) using any immunological or biochemical based method known in the art. For example, specific binding of an antibody to IL-27, may be determined for example using immunological or biochemical based methods such as, but not limited to, an ELISA assay, SPR assays, immunoprecipitation assay, affinity chromatography, and equilibrium dialysis as described above. Immunoassays which can be used to analyze immunospecific binding and cross-reactivity of the antibodies include, but are not limited to, competitive and non-competitive assay systems using techniques such as Western blots, MA, ELISA (enzyme linked immunosorbent assay), "sandwich" immunoassays, immunoprecipitation assays, immunodiffusion assays, agglutination assays, complement-fixation assays, immunoradiometric assays, fluorescent immunoassays, and protein A immunoassays. Such assays are routine and well known in the art.

It is understood that the above methods can also be used to determine if, e.g., an anti-IL-27 antibody does not bind to full-length, human IL-27 and/or IL-27 proteins.

In embodiments where the selected CDR amino acid sequences are short sequences (e.g., fewer than 10-15 amino acids in length), nucleic acids encoding the CDRs can be chemically synthesized as described in, e.g., Shiraishi et al. (2007) *Nucleic Acids Symposium Series* 51(1):129-130 and U.S. Pat. No. 6,995,259. For a given nucleic acid sequence encoding an acceptor antibody, the region of the nucleic acid sequence encoding the CDRs can be replaced with the chemically synthesized nucleic acids using standard molecular biology techniques. The 5' and 3' ends of the chemically synthesized nucleic acids can be synthesized to comprise sticky end restriction enzyme sites for use in cloning the nucleic acids into the nucleic acid encoding the variable region of the donor antibody.

In some embodiments, the anti-IL-27 antibodies described herein comprise an altered heavy chain constant region that has reduced (or no) effector function relative to its corresponding unaltered constant region. Effector functions involving the constant region of the anti-IL-27 antibody may be modulated by altering properties of the constant or Fc region. Altered effector functions include, for example, a modulation in one or more of the following activities: antibody-dependent cellular cytotoxicity (ADCC), complement-dependent cytotoxicity (CDC), apoptosis, binding to one or more Fc-receptors, and pro-inflammatory responses. Modulation refers to an increase, decrease, or elimination of an effector function activity exhibited by a subject antibody containing an altered constant region as compared to the activity of the unaltered form of the constant region. In particular embodiments, modulation includes situations in which an activity is abolished or completely absent.

In one embodiment, the anti-IL-27 antibodies described herein comprise an IgG4 heavy chain constant region. In one embodiment, the IgG4 heavy chain constant region is a wild type IgG4 heavy chain constant region. In another embodiment, the IgG4 constant region comprises a mutation, e.g., one or both of S228P and L235E or L235A, e.g., according to EU numbering (Kabat, E. A., et al., supra). Representative sequences for use in antibodies of the disclosure of wild-type and mutant IgG4 constant regions are set forth in Table 12. In one embodiment, the anti-IL-27 antibodies described herein comprise an IgG1 constant region. In one embodiment, the IgG1 heavy chain constant region is a wild type IgG1 heavy chain constant region. In another embodiment, the IgG1 heavy chain constant region comprises a mutation. Representative sequences for use in antibodies of the disclosure of wild-type and mutant IgG4 constant regions are set forth in Table 12.

An altered constant region with altered FcR binding affinity and/or ADCC activity and/or altered CDC activity is a polypeptide which has either an enhanced or diminished FcR binding activity and/or ADCC activity and/or CDC activity compared to the unaltered form of the constant region. An altered constant region which displays increased binding to an FcR binds at least one FcR with greater affinity than the unaltered polypeptide. An altered constant region which displays decreased binding to an FcR binds at least one FcR with lower affinity than the unaltered form of the constant region. Such variants which display decreased binding to an FcR may possess little or no appreciable binding to an FcR, e.g., 0 to 50% (e.g., less than 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, or 1%) of the binding to the FcR as compared to the level of binding of a native sequence immunoglobulin constant or Fc region to the FcR. Similarly, an altered constant region that displays modulated ADCC and/or CDC activity may exhibit either increased or reduced ADCC and/or CDC activity compared to the unaltered constant region. For example, in some embodiments, the anti-IL-27 antibody comprising an altered constant region can exhibit approximately 0 to 50% (e.g., less than 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, or 1%) of the ADCC and/or CDC activity of the unaltered form of the constant region. An anti-IL-27 antibody described herein comprising an altered constant region displaying reduced ADCC and/or CDC may exhibit reduced or no ADCC and/or CDC activity.

In some embodiments, an anti-IL-27 antibody described herein exhibits reduced or no effector function. In some embodiments, an anti-IL-27 antibody comprises a hybrid constant region, or a portion thereof, such as a G2/G4 hybrid constant region (see e.g., Burton et al. (1992) *Adv Immun* 51:1-18; Canfield et al. (1991) *J Exp Med* 173:1483-1491; and Mueller et al. (1997) *Mol Immunol* 34(6):441-452). See above.

In some embodiments, an anti-IL-27 antibody may contain an altered constant region exhibiting enhanced or reduced complement dependent cytotoxicity (CDC). Modulated CDC activity may be achieved by introducing one or more amino acid substitutions, insertions, or deletions in an Fc region of the antibody. See, e.g., U.S. Pat. No. 6,194,551. Alternatively or additionally, cysteine residue(s) may be introduced in the Fc region, thereby allowing interchain disulfide bond formation in this region. The homodimeric antibody thus generated may have improved or reduced internalization capability and/or increased or decreased complement-mediated cell killing. See, e.g., Caron et al. (1992) *J Exp Med* 176:1191-1195 and Shopes (1992) *Immunol* 148:2918-2922; PCT publication nos. WO 99/51642 and WO 94/29351; Duncan and Winter (1988) Nature 322:738-40; and U.S. Pat. Nos. 5,648,260 and 5,624,821.

Recombinant Antibody Expression and Purification

The antibodies or antigen-binding fragments thereof described herein can be produced using a variety of techniques known in the art of molecular biology and protein chemistry. For example, a nucleic acid encoding one or both of the heavy and light chain polypeptides of an antibody can be inserted into an expression vector that contains transcriptional and translational regulatory sequences, which include, e.g., promoter sequences, ribosomal binding sites, transcriptional start and stop sequences, translational start and stop sequences, transcription terminator signals, polyadenylation signals, and enhancer or activator sequences. The regulatory sequences include a promoter and transcriptional start and stop sequences. In addition, the expression vector can include more than one replication system such that it can be maintained in two different organisms, for example in mammalian or insect cells for expression and in a prokaryotic host for cloning and amplification.

Several possible vector systems are available for the expression of cloned heavy chain and light chain polypeptides from nucleic acids in mammalian cells. One class of vectors relies upon the integration of the desired gene sequences into the host cell genome. Cells which have stably integrated DNA can be selected by simultaneously introducing drug resistance genes such as *E. coli* gpt (Mulligan and Berg (1981) *Proc Natl Acad Sci USA* 78:2072) or Tn5 neo (Southern and Berg (1982) *Mol Appl Genet* 1:327). The selectable marker gene can be either linked to the DNA gene sequences to be expressed, or introduced into the same cell by co-transfection (Wigler et al. (1979) *Cell* 16:77). A second class of vectors utilizes DNA elements which confer autonomously replicating capabilities to an extrachromosomal plasmid. These vectors can be derived from animal viruses, such as bovine papillomavirus (Sarver et al. (1982) *Proc Natl Acad Sci USA,* 79:7147), cytomegalovirus, polyoma virus (Deans et al. (1984) *Proc Natl Acad Sci USA* 81:1292), or SV40 virus (Lusky and Botchan (1981) *Nature* 293:79).

The expression vectors can be introduced into cells in a manner suitable for subsequent expression of the nucleic acid. The method of introduction is largely dictated by the targeted cell type, discussed below. Exemplary methods include $CaPO_4$ precipitation, liposome fusion, cationic liposomes, electroporation, viral infection, dextran-mediated transfection, polybrene-mediated transfection, protoplast fusion, and direct microinjection.

Appropriate host cells for the expression of antibodies or antigen-binding fragments thereof include yeast, bacteria, insect, plant, and mammalian cells. Of particular interest are bacteria such as *E. coli*, fungi such as *Saccharomyces cerevisiae* and *Pichia pastoris*, insect cells such as SF9, mammalian cell lines (e.g., human cell lines), as well as primary cell lines.

In some embodiments, an antibody or fragment thereof can be expressed in, and purified from, transgenic animals (e.g., transgenic mammals). For example, an antibody can be produced in transgenic non-human mammals (e.g., rodents) and isolated from milk as described in, e.g., Houdebine (2002) *Curr Opin Biotechnol* 13(6):625-629; van Kuik-Romeijn et al. (2000) *Transgenic Res* 9(2): 155-159; and Pollock et al. (1999) *J Immunol Methods* 231(1-2): 147-157.

The antibodies and fragments thereof can be produced from the cells by culturing a host cell transformed with the expression vector containing nucleic acid encoding the antibodies or fragments, under conditions, and for an amount of time, sufficient to allow expression of the proteins. Such conditions for protein expression will vary with the choice of the expression vector and the host cell, and will be easily ascertained by one skilled in the art through routine experimentation. For example, antibodies expressed in *E. coli* can be refolded from inclusion bodies (see, e.g., Hou et al. (1998) *Cytokine* 10:319-30). Bacterial expression systems and methods for their use are well known in the art (see Current Protocols in Molecular Biology, Wiley & Sons, and Molecular Cloning—A Laboratory Manual—3rd Ed., Cold Spring Harbor Laboratory Press, New York (2001)). The choice of codons, suitable expression vectors and suitable host cells will vary depending on a number of factors, and may be easily optimized as needed. An antibody (or fragment thereof) described herein can be expressed in mammalian cells or in other expression systems including but not limited to yeast, baculovirus, and in vitro expression systems (see, e.g., Kaszubska et al. (2000) *Protein Expression and Purification* 18:213-220).

Following expression, the antibodies and fragments thereof can be isolated. An antibody or fragment thereof can be isolated or purified in a variety of ways known to those skilled in the art depending on what other components are present in the sample. Standard purification methods include electrophoretic, molecular, immunological, and chromatographic techniques, including ion exchange, hydrophobic, affinity, and reverse-phase HPLC chromatography. For example, an antibody can be purified using a standard anti-antibody column (e.g., a protein-A or protein-G column). Ultrafiltration and diafiltration techniques, in conjunction with protein concentration, are also useful. See, e.g., Scopes (1994) "Protein Purification, $3^{rd}$ edition," Springer-Verlag, New York City, New York. The degree of purification necessary will vary depending on the desired use. In some instances, no purification of the expressed antibody or fragments thereof will be necessary.

Methods for determining the yield or purity of a purified antibody or fragment thereof are known in the art and include, e.g., Bradford assay, UV spectroscopy, Biuret protein assay, Lowry protein assay, amido black protein assay, high pressure liquid chromatography (HPLC), mass spectrometry (MS), and gel electrophoretic methods (e.g., using a protein stain such as Coomassie Blue or colloidal silver stain).

Modification of the Antibodies or Antigen-Binding Fragments Thereof

The antibodies or antigen-binding fragments thereof can be modified following their expression and purification. The modifications can be covalent or non-covalent modifications. Such modifications can be introduced into the antibodies or fragments by, e.g., reacting targeted amino acid residues of the polypeptide with an organic derivatizing agent that is capable of reacting with selected side chains or terminal residues. Suitable sites for modification can be chosen using any of a variety of criteria including, e.g., structural analysis or amino acid sequence analysis of the antibodies or fragments.

In some embodiments, the antibodies or antigen-binding fragments thereof can be conjugated to a heterologous moiety. The heterologous moiety can be, e.g., a heterologous polypeptide, a therapeutic agent (e.g., a toxin or a drug), or a detectable label such as, but not limited to, a radioactive label, an enzymatic label, a fluorescent label, a heavy metal label, a luminescent label, or an affinity tag such as biotin or streptavidin. Suitable heterologous polypeptides include, e.g., an antigenic tag (FLAG (DYKDDDDK (SEQ ID NO: 405)), polyhistidine (6-His; HHHHHH (SEQ ID NO: 406), hemagglutinin (HA; YPYDVPDYA (SEQ ID NO: 407)), glutathione-S-transferase (GST), or maltose-binding protein (MBP)) for use in purifying the antibodies or fragments. Heterologous polypeptides also include polypeptides (e.g., enzymes) that are useful as diagnostic or detectable markers, for example, luciferase, a fluorescent protein (e.g., green fluorescent protein (GFP)), or chloramphenicol acetyl transferase (CAT). Suitable radioactive labels include, e.g., $^{32}P$, $^{33}P$, $^{14}C$, $^{125}I$, $^{131}I$, $^{35}S$, and $^{3}H$. Suitable fluorescent labels include, without limitation, fluorescein, fluorescein isothiocyanate (FITC), green fluorescent protein (GFP), DyLight™ 488, phycoerythrin (PE), propidium iodide (PI), PerCP, PE-Alexa Fluor® 700, Cy5, allophycocyanin, and Cy7. Luminescent labels include, e.g., any of a variety of luminescent lanthanide (e.g., europium or terbium) chelates. For example, suitable europium chelates include the europium chelate of diethylene triamine pentaacetic acid (DTPA) or tetraazacyclododecane-1,4,7,10-tetraacetic acid (DOTA). Enzymatic labels include, e.g., alkaline phosphatase, CAT, luciferase, and horseradish peroxidase.

Two proteins (e.g., an antibody and a heterologous moiety) can be cross-linked using any of a number of known chemical cross linkers. Examples of such cross linkers are those which link two amino acid residues via a linkage that includes a "hindered" disulfide bond. In these linkages, a disulfide bond within the cross-linking unit is protected (by hindering groups on either side of the disulfide bond) from reduction by the action, for example, of reduced glutathione or the enzyme disulfide reductase. One suitable reagent, 4-succinimidyloxycarbonyl-α-methyl-α(2-pyridyldithio) toluene (SMPT), forms such a linkage between two proteins utilizing a terminal lysine on one of the proteins and a terminal cysteine on the other. Heterobifunctional reagents that cross-link by a different coupling moiety on each protein can also be used. Other useful cross-linkers include, without limitation, reagents which link two amino groups (e.g., N-5-azido-2-nitrobenzoyloxysuccinimide), two sulfhydryl groups (e.g., 1,4-bis-maleimidobutane), an amino group and a sulfhydryl group (e.g., m-maleimidobenzoyl-N-hydroxysuccinimide ester), an amino group and a carboxyl group (e.g., 4-[p-azidosalicylamido]butylamine), and an amino group and a guanidinium group that is present in the side chain of arginine (e.g., p-azidophenyl glyoxal monohydrate).

In some embodiments, a radioactive label can be directly conjugated to the amino acid backbone of the antibody. Alternatively, the radioactive label can be included as part of a larger molecule (e.g., $^{125}$I in meta-[$^{125}$I]iodophenyl-N-hydroxysuccinimide ([$^{125}$I]mIPNHS) which binds to free amino groups to form meta-iodophenyl (mIP) derivatives of relevant proteins (see, e.g., Rogers et al. (1997) *J Nucl Med* 38:1221-1229) or chelate (e.g., to DOTA or DTPA) which is in turn bound to the protein backbone. Methods of conjugating the radioactive labels or larger molecules/chelates containing them to the antibodies or antigen-binding fragments described herein are known in the art. Such methods involve incubating the proteins with the radioactive label under conditions (e.g., pH, salt concentration, and/or temperature) that facilitate binding of the radioactive label or chelate to the protein (see, e.g., U.S. Pat. No. 6,001,329).

Methods for conjugating a fluorescent label (sometimes referred to as a "fluorophore") to a protein (e.g., an antibody) are known in the art of protein chemistry. For example, fluorophores can be conjugated to free amino groups (e.g., of lysines) or sulfhydryl groups (e.g., cysteines) of proteins using succinimidyl (NETS) ester or tetrafluorophenyl (TFP) ester moieties attached to the fluorophores. In some embodiments, the fluorophores can be conjugated to a heterobifunctional cross-linker moiety such as sulfo-SMCC. Suitable conjugation methods involve incubating an antibody protein, or fragment thereof, with the fluorophore under conditions that facilitate binding of the fluorophore to the protein. See, e.g., Welch and Redvanly (2003) "Handbook of Radiopharmaceuticals: Radiochemistry and Applications," John Wiley and Sons (ISBN 0471495603).

In some embodiments, the antibodies or fragments can be modified, e.g., with a moiety that improves the stabilization and/or retention of the antibodies in circulation, e.g., in blood, serum, or other tissues. For example, the antibody or fragment can be PEGylated as described in, e.g., Lee et al. (1999) Bioconjug Chem 10(6): 973-8; Kinstler et al. (2002) *Advanced Drug Deliveries Reviews* 54:477-485; and Roberts et al. (2002) *Advanced Drug Delivery Reviews* 54:459-476 or HESylated (Fresenius Kabi, Germany; see, e.g., Pavišić et al. (2010) *Int J Pharm* 387(1-2):110-119). The stabilization moiety can improve the stability, or retention of, the antibody (or fragment) by at least 1.5 (e.g., at least 2, 5, 10, 15, 20, 25, 30, 40, or 50 or more) fold.

In some embodiments, the antibodies or antigen-binding fragments thereof described herein can be glycosylated. In some embodiments, an antibody or antigen-binding fragment thereof described herein can be subjected to enzymatic or chemical treatment, or produced from a cell, such that the antibody or fragment has reduced or absent glycosylation. Methods for producing antibodies with reduced glycosylation are known in the art and described in, e.g., U.S. Pat. No. 6,933,368; Wright et al. (1991) *EMBO J* 10(10):2717-2723; and Co et al. (1993) *Mol Immunol* 30:1361.

Pharmaceutical Compositions and Formulations

In certain embodiments, the invention provides for a pharmaceutical composition comprising an anti-IL-27 antibody with a pharmaceutically acceptable diluent, carrier, solubilizer, emulsifier, preservative and/or adjuvant.

In certain embodiments, acceptable formulation materials preferably are nontoxic to recipients at the dosages and concentrations employed. In certain embodiments, the formulation material(s) are for s.c. and/or I.V. administration. In certain embodiments, the pharmaceutical composition can contain formulation materials for modifying, maintaining or preserving, for example, the pH, osmolality, viscosity, clarity, color, isotonicity, odor, sterility, stability, rate of dissolution or release, adsorption or penetration of the composition. In certain embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate 80, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. (Remington's Pharmaceutical Sciences, 18th Edition, A. R. Gennaro, ed., Mack Publishing Company (1995). In certain embodiments, the formulation comprises PBS; 20 mM NaOAC, pH 5.2, 50 mM NaCl; and/or 10 mM NAOAC, pH 5.2, 9% Sucrose. In certain embodiments, the optimal pharmaceutical composition will be determined by one skilled in the art depending upon, for example, the intended route of administration, delivery format and desired dosage. See, for example, Remington's Pharmaceutical Sciences, supra. In certain embodiments, such compositions may influence the physical state, stability, rate of in vivo release and/or rate of in vivo clearance of the anti-IL-27 antibody.

In certain embodiments, the primary vehicle or carrier in a pharmaceutical composition can be either aqueous or non-aqueous in nature. For example, in certain embodiments, a suitable vehicle or carrier can be water for injection, physiological saline solution or artificial cerebrospinal fluid, possibly supplemented with other materials common in compositions for parenteral administration. In certain embodiments, the saline comprises isotonic phosphate-buffered saline. In certain embodiments, neutral buffered saline or saline mixed with serum albumin are further exemplary vehicles. In certain embodiments, pharmaceutical compositions comprise Tris buffer of about pH 7.0-8.5, or acetate buffer of about pH 4.0-5.5, which can further include sorbitol or a suitable substitute therefore. In certain embodiments, a composition comprising an anti-IL-27 antibody can be prepared for storage by mixing the selected composition having the desired degree of purity with optional formulation agents (Remington's Pharmaceutical Sciences, supra) in the form of a lyophilized cake or an aqueous solution. Further, in certain embodiments, a composition comprising an anti-IL-27 antibody can be formulated as a lyophilizate using appropriate excipients such as sucrose.

In certain embodiments, the pharmaceutical composition can be selected for parenteral delivery. In certain embodiments, the compositions can be selected for inhalation or for delivery through the digestive tract, such as orally. The preparation of such pharmaceutically acceptable compositions is within the ability of one skilled in the art.

In certain embodiments, the formulation components are present in concentrations that are acceptable to the site of administration. In certain embodiments, buffers are used to maintain the composition at physiological pH or at a slightly lower pH, typically within a pH range of from about 5 to about 8.

In certain embodiments, when parenteral administration is contemplated, a therapeutic composition can be in the form of a pyrogen-free, parenterally acceptable aqueous solution comprising an anti-IL-27 antibody, in a pharmaceutically acceptable vehicle. In certain embodiments, a vehicle for parenteral injection is sterile distilled water in which an anti-IL-27 antibody is formulated as a sterile, isotonic solution, and properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that can provide for the controlled or sustained release of the product which can then be delivered via a depot injection. In certain embodiments, hyaluronic acid can also be used, and can have the effect of promoting sustained duration in the circulation. In certain embodiments, implantable drug delivery devices can be used to introduce the desired molecule.

In certain embodiments, a pharmaceutical composition can be formulated for inhalation. In certain embodiments, an anti-IL-27 antibody can be formulated as a dry powder for inhalation. In certain embodiments, an inhalation solution comprising an anti-IL-27 antibody can be formulated with a propellant for aerosol delivery. In certain embodiments, solutions can be nebulized. Pulmonary administration is further described in PCT application No. PCT/US94/001875, which describes pulmonary delivery of chemically modified proteins.

In certain embodiments, it is contemplated that formulations can be administered orally. In certain embodiments, an anti-IL-27 antibody that is administered in this fashion can be formulated with or without those carriers customarily used in the compounding of solid dosage forms such as tablets and capsules. In certain embodiments, a capsule can be designed to release the active portion of the formulation at the point in the gastrointestinal tract when bioavailability is maximized and pre-systemic degradation is minimized. In certain embodiments, at least one additional agent can be included to facilitate absorption of an anti-IL-27 antibody. In certain embodiments, diluents, flavorings, low melting point waxes, vegetable oils, lubricants, suspending agents, tablet disintegrating agents, and binders can also be employed.

In certain embodiments, a pharmaceutical composition can involve an effective quantity of an anti-IL-27 antibody in a mixture with non-toxic excipients which are suitable for the manufacture of tablets. In certain embodiments, by dissolving the tablets in sterile water, or another appropriate vehicle, solutions can be prepared in unit-dose form. In certain embodiments, suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions will be evident to those skilled in the art, including formulations involving an anti-IL-27 antibody in sustained- or controlled-delivery formulations. In certain embodiments, techniques for formulating a variety of other sustained- or controlled-delivery means, such as liposome carriers, bio-erodible microparticles or porous beads and depot injections, are also known to those skilled in the art. See for example, PCT Application No. PCT/US93/00829 which describes the controlled release of porous polymeric microparticles for the delivery of pharmaceutical compositions. In certain embodiments, sustained-release preparations can include semipermeable polymer matrices in the form of shaped articles, e.g. films, or microcapsules. Sustained release matrices can include polyesters, hydrogels, polylactides (U.S. Pat. No. 3,773,919 and EP 058,481), copolymers of L-glutamic acid and gamma ethyl-L-glutamate (Sidman et al., Biopolymers, 22:547-556 (1983)), poly (2-hydroxyethyl-methacrylate) (Langer et al., J. Biomed. Mater. Res., 15: 167-277 (1981) and Langer, Chem. Tech., 12:98-105 (1982)), ethylene vinyl acetate (Langer et al., supra) or poly-D(−)-3-hydroxybutyric acid (EP 133,988). In certain embodiments, sustained release compositions can also include liposomes, which can be prepared by any of several methods known in the art. See, e.g., Eppstein et al, Proc. Natl. Acad. Sci. USA, 82:3688-3692 (1985); EP 036,676; EP 088,046 and EP 143,949.

The pharmaceutical composition to be used for in vivo administration typically is sterile. In certain embodiments, this can be accomplished by filtration through sterile filtration membranes. In certain embodiments, where the composition is lyophilized, sterilization using this method can be conducted either prior to or following lyophilization and reconstitution. In certain embodiments, the composition for parenteral administration can be stored in lyophilized form or in a solution. In certain embodiments, parenteral compositions generally are placed into a container having a sterile access port, for example, an intravenous solution bag or vial having a stopper pierceable by a hypodermic injection needle.

In certain embodiments, once the pharmaceutical composition has been formulated, it can be stored in sterile vials as a solution, suspension, gel, emulsion, solid, or as a dehydrated or lyophilized powder. In certain embodiments, such formulations can be stored either in a ready-to-use form or in a form (e.g., lyophilized) that is reconstituted prior to administration.

In certain embodiments, kits are provided for producing a single-dose administration unit. In certain embodiments, the kit can contain both a first container having a dried protein and a second container having an aqueous formulation. In certain embodiments, kits containing single and multi-chambered pre-filled syringes (e.g., liquid syringes and lyosyringes) are included.

In certain embodiments, the effective amount of a pharmaceutical composition comprising an anti-IL-27 antibody to be employed therapeutically will depend, for example, upon the therapeutic context and objectives. One skilled in the art will appreciate that the appropriate dosage levels for treatment, according to certain embodiments, will thus vary depending, in part, upon the molecule delivered, the indication for which an anti-IL-27 antibody is being used, the route of administration, and the size (body weight, body surface or organ size) and/or condition (the age and general health) of the patient. In certain embodiments, the clinician can titer the dosage and modify the route of administration to obtain the optimal therapeutic effect.

In certain embodiments, the frequency of dosing will take into account the pharmacokinetic parameters of an anti-IL-27 antibody in the formulation used. In certain embodiments, a clinician will administer the composition until a dosage is reached that achieves the desired effect. In certain embodiments, the composition can therefore be administered as a single dose or as two or more doses (which may or may not contain the same amount of the desired molecule) over time, or as a continuous infusion via an implantation device or catheter. Further refinement of the appropriate dosage is routinely made by those of ordinary skill in the art and is within the ambit of tasks routinely performed by them. In certain embodiments, appropriate dosages can be ascertained through use of appropriate dose-response data.

In certain embodiments, the route of administration of the pharmaceutical composition is in accord with known methods, e.g. orally, through injection by intravenous, intraperitoneal, intracerebral (intra-parenchymal), intracerebroventricular, intramuscular, subcutaneously, intra-ocular, intraarterial, intraportal, or intralesional routes; by sustained release systems or by implantation devices. In certain embodiments, the compositions can be administered by bolus injection or continuously by infusion, or by implantation device. In certain embodiments, individual elements of the combination therapy may be administered by different routes.

In certain embodiments, the composition can be administered locally via implantation of a membrane, sponge or another appropriate material onto which the desired molecule has been absorbed or encapsulated. In certain embodiments, where an implantation device is used, the device can be implanted into any suitable tissue or organ, and delivery of the desired molecule can be via diffusion, timed-release bolus, or continuous administration. In certain embodiments, it can be desirable to use a pharmaceutical composition comprising an anti-IL-27 antibody in an ex vivo manner. In such instances, cells, tissues and/or organs that have been removed from the patient are exposed to a pharmaceutical composition comprising an anti-IL-27 antibody after which the cells, tissues and/or organs are subsequently implanted back into the patient.

In certain embodiments, an anti-IL-27 antibody can be delivered by implanting certain cells that have been genetically engineered, using methods such as those described herein, to express and secrete the polypeptides. In certain embodiments, such cells can be animal or human cells, and can be autologous, heterologous, or xenogeneic. In certain embodiments, the cells can be immortalized. In certain embodiments, in order to decrease the chance of an immunological response, the cells can be encapsulated to avoid infiltration of surrounding tissues. In certain embodiments, the encapsulation materials are typically biocompatible, semi-permeable polymeric enclosures or membranes that allow the release of the protein product(s) but prevent the destruction of the cells by the patient's immune system or by other detrimental factors from the surrounding tissues.

Applications

The compositions described herein can be used in a number of diagnostic and therapeutic applications. For example, detectably-labeled antigen-binding molecules can be used in assays to detect the presence or amount of the target antigens in a sample (e.g., a biological sample). The compositions can be used in in vitro assays for studying inhibition of target antigen function. In some embodiments, e.g., in which the compositions bind to and inhibit a complement protein, the compositions can be used as positive controls in assays designed to identify additional novel compounds that inhibit complement activity or otherwise are useful for treating a complement-associated disorder. For example, an IL-27-inhibiting composition can be used as a positive control in an assay to identify additional compounds (e.g., small molecules, aptamers, or antibodies) that reduce or abrogate IL-27 production. The compositions can also be used in therapeutic methods as elaborated on below.

In some embodiments, the disclosure provides a method of detecting IL-27 in a biological sample or in a subject, comprising (i) contacting the sample or the subject (and optionally, a reference sample or subject) with any antibody described herein under conditions that allow interaction of the antibody molecule and IL-27 to occur, and (ii) detecting formation of a complex between the antibody molecule and the sample or the subject (and optionally, the reference sample or subject).

Kits

A kit can include an anti-IL-27 antibody as disclosed herein, and instructions for use. The kits may comprise, in a suitable container, an anti-IL-27 antibody, one or more controls, and various buffers, reagents, enzymes and other standard ingredients well known in the art. In some aspects, the disclosure provides a kit comprising an anti-IL-27 antibody or antigen-binding portion as disclosed herein, and instructions for use in stimulating an immune response in a subject, or treating cancer in a subject, optionally with instructions for use in combination with one or more additional therapeutic agents or procedure as disclosed herein.

The container can include at least one vial, well, test tube, flask, bottle, syringe, or other container means, into which an anti-IL-27 antibody may be placed, and in some instances, suitably aliquoted. Where an additional component is provided, the kit can contain additional containers into which this component may be placed. The kits can also include a means for containing an anti-IL-27 antibody and any other reagent containers in close confinement for commercial sale. Such containers may include injection or blow-molded plastic containers into which the desired vials are retained. Containers and/or kits can include labeling with instructions for use and/or warnings.

Methods of Use

The compositions of the present invention have numerous in vitro and in vivo utilities involving the detection and/or quantification of IL-27 and/or the antagonism of IL-27 function.

In some embodiments, the disclosure provides a method to inhibit or reduce STAT1 and/or STAT3 phosphorylation in a cell, the method comprising contacting the cell with an isolated monoclonal antibody, or antigen binding fragment, provided by the disclosure, wherein the antibody, or antigen binding portion thereof, inhibits or reduces STAT1 and/or STAT3 phosphorylation in a cell.

In some embodiments, the disclosure provides a method to inhibit or reduce inhibition of CD161 expression in a cell, the method comprising contacting the cell with an isolated monoclonal antibody, or antigen binding fragment, provided by the disclosure, wherein the antibody, or antigen binding portion thereof, inhibits or reduces inhibition of CD161 expression in a cell.

In some embodiments, the disclosure provides a method to inhibit or reduce PD-L1 and/or TIM-3 expression in a cell, the method comprising contacting the cell with an isolated monoclonal antibody, or antigen binding fragment, provided by the disclosure, wherein the antibody, or antigen binding portion thereof, inhibits or PD-L1 and/or TIM-3 expression in a cell.

In some embodiments, the disclosure provides a method to induce or enhance secretion of one or more cytokines from a cell, the method comprising contacting the cell with the isolated monoclonal antibody, or antigen binding fragment, provided by the disclosure, wherein the antibody, or antigen binding portion thereof, induces or enhances PD-1 mediated secretion of one or more cytokines from a cell.

In some embodiments, the disclosure provides a method of stimulating an immune response in a subject, the method comprising administering to the subject an effective amount of an isolated monoclonal antibody, or antigen binding portion thereof, that specifically binds to and antagonizes IL-27, provided by the disclosure, or a pharmaceutical composition comprising the antibody or antigen binding portion thereof, and a pharmaceutically acceptable carrier.

In some embodiments, the disclosure provides a method of treating a cancer in a subject, the method comprising administering to the subject an effective amount an isolated monoclonal antibody, or antigen binding portion thereof, that specifically binds to and antagonizes IL-27, provided by the disclosure, or a pharmaceutical composition comprising the antibody or antigen binding portion thereof, and a pharmaceutically acceptable carrier.

In some embodiments, the disclosure provides a method of stimulating an immune response, or treating a cancer in a subject, the method comprising administering to the subject an effective amount of an isolated monoclonal antibody, or antigen binding fragment, provided by the disclosure, or a pharmaceutical composition comprising the antibody or antigen binding portion thereof, and a pharmaceutically acceptable carrier, wherein the antibody, or antigen binding portion thereof, or the pharmaceutical composition, inhibits or reduces STAT1 and/or STAT3 phosphorylation in a cell, thereby stimulating the immune response, or treating the cancer.

In some embodiments, the disclosure provides a method of stimulating an immune response, or treating a cancer in a subject, the method comprising administering to the subject an effective amount of an isolated monoclonal antibody, or antigen binding fragment, provided by the disclosure, or a pharmaceutical composition comprising the antibody or antigen binding portion thereof, and a pharmaceutically acceptable carrier, wherein the antibody, or antigen binding portion thereof, or the pharmaceutical composition, inhibits or reduces inhibition of CD161 expression in a cell, thereby stimulating the immune response, or treating the cancer.

In some embodiments, the disclosure provides a method of stimulating an immune response, or treating a cancer in a subject, the method comprising administering to the subject an effective amount of an isolated monoclonal antibody, or antigen binding fragment, provided by the disclosure, or a pharmaceutical composition comprising the antibody or antigen binding portion thereof, and a pharmaceutically acceptable carrier, wherein the antibody, or antigen binding portion thereof, or the pharmaceutical composition, inhibits or reduces PD-L1 and/or TIM-3 expression in a cell, thereby stimulating the immune response, or treating the cancer.

In some embodiments, the disclosure provides a method of stimulating an immune response, or treating a cancer in a subject, the method comprising administering to the subject an effective amount of an isolated monoclonal antibody, or antigen binding fragment, provided by the disclosure, or a pharmaceutical composition comprising the antibody or antigen binding portion thereof, and a pharmaceutically acceptable carrier, wherein the antibody, or antigen binding portion thereof, or the pharmaceutical composition, induces or enhances PD-1-mediated secretion of one or more cytokines from a cell, thereby stimulating the immune response, or treating the cancer.

In some embodiments, the cancer is chosen from lung cancer (e.g., non-small cell lung cancer), sarcoma, testicular cancer, ovarian cancer, pancreas cancer, breast cancer (e.g., triple-negative breast cancer), melanoma, head and neck cancer (e.g., squamous head and neck cancer), colorectal cancer, bladder cancer, endometrial cancer, prostate cancer, thyroid cancer, hepatocellular carcinoma, gastric cancer, brain cancer, lymphoma (e.g., DL-BCL), leukemia (e.g., AML) or renal cancer (e.g., renal cell carcinoma, e.g., renal clear cell carcinoma).

The above-described compositions are useful in, inter alia, methods for treating or preventing a variety of cancers in a subject. The compositions can be administered to a subject, e.g., a human subject, using a variety of methods that depend, in part, on the route of administration. The route can be, e.g., intravenous injection or infusion (IV), subcutaneous injection (SC), intraperitoneal (IP) injection, intramuscular injection (IM), or intrathecal injection (IT). The injection can be in a bolus or a continuous infusion.

Administration can be achieved by, e.g., local infusion, injection, or by means of an implant. The implant can be of a porous, non-porous, or gelatinous material, including membranes, such as sialastic membranes, or fibers. The implant can be configured for sustained or periodic release of the composition to the subject. See, e.g., U.S. Patent Application Publication No. 20080241223; U.S. Pat. Nos. 5,501,856; 4,863,457; and 3,710,795; EP488401; and EP 430539, the disclosures of each of which are incorporated herein by reference in their entirety. The composition can be delivered to the subject by way of an implantable device based on, e.g., diffusive, erodible, or convective systems, e.g., osmotic pumps, biodegradable implants, electrodiffusion systems, electroosmosis systems, vapor pressure pumps, electrolytic pumps, effervescent pumps, piezoelectric pumps, erosion-based systems, or electromechanical systems.

In some embodiments, an anti-IL-27 antibody or antigen-binding fragment thereof is therapeutically delivered to a subject by way of local administration.

A suitable dose of an antibody or fragment thereof described herein, which dose is capable of treating or preventing cancer in a subject, can depend on a variety of factors including, e.g., the age, sex, and weight of a subject to be treated and the particular inhibitor compound used. For example, a different dose of a whole anti-IL-27 antibody may be required to treat a subject with cancer as compared to the dose of a IL-27-binding Fab' antibody fragment required to treat the same subject. Other factors affecting the dose administered to the subject include, e.g., the type or severity of the cancer. For example, a subject having metastatic melanoma may require administration of a different dosage of an anti-IL-27 antibody than a subject with glioblastoma. Other factors can include, e.g., other medical disorders concurrently or previously affecting the subject, the general health of the subject, the genetic disposition of the subject, diet, time of administration, rate of excretion, drug combination, and any other additional therapeutics that are administered to the subject. It should also be understood that a specific dosage and treatment regimen for any particular subject will also depend upon the judgment of the treating medical practitioner (e.g., doctor or nurse). Suitable dosages are described herein.

A pharmaceutical composition can include a therapeutically effective amount of an anti-IL-27 antibody or antigen-binding fragment thereof described herein. Such effective amounts can be readily determined by one of ordinary skill in the art based, in part, on the effect of the administered antibody, or the combinatorial effect of the antibody and one or more additional active agents, if more than one agent is used. A therapeutically effective amount of an antibody or fragment thereof described herein can also vary according to factors such as the disease state, age, sex, and weight of the individual, and the ability of the antibody (and one or more additional active agents) to elicit a desired response in the individual, e.g., reduction in tumor growth. For example, a therapeutically effective amount of an anti-IL-27 antibody can inhibit (lessen the severity of or eliminate the occurrence of) and/or prevent a particular disorder, and/or any one of the symptoms of the particular disorder known in the art or described herein. A therapeutically effective amount is also one in which any toxic or detrimental effects of the composition are outweighed by the therapeutically beneficial effects.

Suitable human doses of any of the antibodies or fragments thereof described herein can further be evaluated in, e.g., Phase I dose escalation studies. See, e.g., van Gurp et al. (2008) *Am J Transplantation* 8(8):1711-1718; Hanouska et al. (2007) *Clin Cancer Res* 13(2, part 1):523-531; and Hetherington et al. (2006) *Antimicrobial Agents and Chemotherapy* 50(10): 3499-3500.

In some embodiments, the composition contains any of the antibodies or antigen-binding fragments thereof described herein and one or more (e.g., two, three, four, five, six, seven, eight, nine, 10, or 11 or more) additional therapeutic agents such that the composition as a whole is therapeutically effective. For example, a composition can contain an anti-IL-27 antibody described herein and an alkylating agent, wherein the antibody and agent are each at a concentration that when combined are therapeutically effective for treating or preventing a cancer (e.g., melanoma) in a subject.

Toxicity and therapeutic efficacy of such compositions can be determined by known pharmaceutical procedures in cell cultures or experimental animals (e.g., animal models of any of the cancers described herein). These procedures can be used, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. An antibody or antigen-binding fragment thereof that exhibits a high therapeutic index is preferred. While compositions that exhibit toxic side effects may be used, care should be taken to design a delivery system that targets such compounds to the site of affected tissue and to minimize potential damage to normal cells and, thereby, reduce side effects.

The data obtained from the cell culture assays and animal studies can be used in formulating a range of dosage for use in humans. The dosage of such antibodies or antigen-binding fragments thereof generally lies within a range of circulating concentrations of the antibodies or fragments that include the $ED_{50}$ with little or no toxicity. The dosage may vary within this range depending upon the dosage form employed and the route of administration utilized. For an anti-IL-27 antibody described herein, the therapeutically effective dose can be estimated initially from cell culture assays. A dose can be formulated in animal models to achieve a circulating plasma concentration range that includes the $IC_{50}$ (i.e., the concentration of the antibody which achieves a half-maximal inhibition of symptoms) as determined in cell culture. Such information can be used to more accurately determine useful doses in humans. Levels in plasma may be measured, for example, by high performance liquid chromatography. In some embodiments, e.g., where local administration (e.g., to the eye or a joint) is desired, cell culture or animal modeling can be used to determine a dose required to achieve a therapeutically effective concentration within the local site.

In some embodiments, the methods can be performed in conjunction with other therapies for cancer. For example, the composition can be administered to a subject at the same time, prior to, or after, radiation, surgery, targeted or cytotoxic chemotherapy, chemoradiotherapy, hormone therapy, immunotherapy, gene therapy, cell transplant therapy, precision medicine, genome editing therapy, or other pharmacotherapy.

As described above, the compositions described herein (e.g., anti-IL-27 compositions) can be used to treat a variety of cancers such as but not limited to: Kaposi's sarcoma, leukemia, acute lymphocytic leukemia, acute myelocytic leukemia, myeloblasts promyelocyte myelomonocytic monocytic erythroleukemia, chronic leukemia, chronic myelocytic (granulocytic) leukemia, chronic lymphocytic leukemia, mantle cell lymphoma, primary central nervous system lymphoma, Burkitt's lymphoma and marginal zone B cell lymphoma, Polycythemia vera Lymphoma, Hodgkin's disease, non-Hodgkin's disease, multiple myeloma, Waldenstrom's macroglobulinemia, heavy chain disease, solid tumors, sarcomas, and carcinomas, fibrosarcoma, myxosarcoma, liposarcoma, chrondrosarcoma, osteogenic sarcoma, osteosarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon sarcoma, colorectal carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatocellular carcinoma (HCC), hepatoma, bile duct carcinoma, choriocarcinoma, seminoma, embryonal carcinoma, Wilm's tumor, cervical cancer, uterine cancer, testicular tumor, lung carcinoma, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, menangioma, melanoma, neuroblastoma, retinoblastoma, nasopharyngeal carcinoma, esophageal carcinoma, basal cell carcinoma, biliary tract cancer, bladder cancer, bone cancer, brain and central nervous system (CNS) cancer, cervical cancer, choriocarcinoma, colorectal cancers, connective tissue cancer, cancer of the digestive system, endometrial cancer, esophageal cancer, eye cancer, head and neck cancer, gastric cancer, intraepithelial neoplasm, kidney cancer, larynx cancer, liver cancer, lung cancer (small cell, large cell), melanoma, neuroblastoma; oral cavity cancer (for example lip, tongue, mouth and pharynx), ovarian cancer, pancreatic cancer, retinoblastoma, rhabdomyosarcoma, rectal cancer; cancer of the respiratory system, sarcoma, skin cancer, stomach cancer, testicular cancer, thyroid cancer, uterine cancer, and cancer of the urinary system.

Combination Therapy

In some embodiments, an anti-IL-27 antibody, or antigen binding portion thereof, provided by the disclosure, can be combined with one or more additional therapeutics or treatments, e.g., another therapeutic or treatment for a cancer. For example, the anti-IL-27 antibody, or antigen binding portion thereof, can be administered to a subject (e.g., a human patient) in combination with one or more additional therapeutics, wherein the combination provides a therapeutic benefit to a subject who has, or is at risk of developing, cancer.

In some embodiments, an anti-IL-27 antibody, or antigen binding portion thereof, and the one or more additional therapeutics are administered at the same time (e.g., simultaneously). In other embodiments, the anti-IL-27 antibody, or antigen binding portion thereof, is administered first in time and the one or more additional therapeutics are administered second in time (e.g., sequentially). In some embodiments, the one or more additional therapeutics are administered first in time and the anti-IL-27 antibody is administered second in time.

An anti-IL-27 antibody or an antigen-binding fragment thereof described herein can replace or augment a previously or currently administered therapy. For example, upon treating with an anti-IL-27 antibody or antigen-binding fragment thereof, administration of the one or more additional therapeutics can cease or diminish, e.g., be administered at lower levels. In some embodiments, administration of the previous therapy can be maintained. In some embodiments, a previous therapy will be maintained until the level of the anti-IL-27 antibody reaches a level sufficient to provide a therapeutic effect.

In some embodiments, the disclosure provides a method of treating cancer in a subject, the method comprising administering to the subject an effective amount of an isolated monoclonal antibody, or antigen binding portion thereof, that specifically binds to and antagonizes IL-27, provided by the disclosure, in combination with one or more additional therapeutic agents or procedure, wherein the second therapeutic agent or procedure is selected from the group consisting of: a chemotherapy, a targeted anti-cancer therapy, an oncolytic drug, a cytotoxic agent, an immune-based therapy, a cytokine, surgical procedure, a radiation procedure, an activator of a costimulatory molecule, an inhibitor of an inhibitory molecule, a vaccine, or a cellular immunotherapy, or a combination thereof.

In some embodiments, the one or more additional therapeutic agents is a PD-1 antagonist, a TIM-3 inhibitor, a LAG-3 inhibitor, a TIGIT inhibitor, a CD112R inhibitor, a TAM inhibitor, a STING agonist, a 4-1BB agonist, or a combination thereof.

In some embodiments, the one or more additional therapeutic agents is a PD-1 antagonist. In some embodiments, the PD-1 antagonist is selected from the group consisting of: PDR001, nivolumab, pembrolizumab, pidilizumab, MEDI0680, REGN2810, TSR-042, PF-06801591, AMP-224, AB122, and JTX-4014. In certain embodiments, the one or more additional therapeutic agents is a PD-L1 inhibitor. In some embodiments, the PD-L1 inhibitor is selected from the group consisting of: FAZ053, Atezolizumab, Avelumab, Durvalumab, and BMS-936559. In some embodiments, the disclosure provides a method of enhancing one or more activities of an anti-PD-1 antibody (e.g., enhances PD-1-mediated cytokine secretion; enhances anti-PD-1 mediated TNFα secretion; enhances anti-PD-1 mediated IL-6 secretion from a cell exposed to anti-PD-1 antibodies), the method comprising exposing a cell to an antibody, or antigen binding portion thereof, provided by the disclosure, concurrently with or sequentially to an anti-PD-1 antibody, thereby to enhance one or more activities of the anti-PD1 antibody.

In some embodiments, the one or more additional therapeutic agents is sunitinib (Sutent), Cabozantinib) (Cabometyx®, Axitinib (Inlyta®), Lenvatinib (Lenvima®), Everolimus (Afinitor®), Bevacizumab (Avastin®), epacadostat, NKTR-214 (CD-122-biased agonist), tivozanib (Fotivda®), abexinostat, Ipilimumab (Yervoy®), tremelimumab, Pazopanib (Votrient®), Sorafenib (Nexavar®), Temsirolimus (Toriser), Ramucirumab (Cyramza®), niraparib, savolitinib, vorolanib (X-82), Regorafenib (Stivargo®), Donafenib (multikinase inhibitor), Camrelizumab (SHR-1210), pexastimogene devacirepvec (JX-594), Ramucirumab (Cyramza®), apatinib (YN968D1), encapsulated doxorubicin (Thermodox®), Tivantinib (ARQ197), ADI-PEG 20, binimetinib, apatinib mesylate, nintedanib, lirilumab, Nivolumab (Opdivo®), Pembrolizumab (Keytruda®), Atezolizumab (Tecentriq®), Avelumab (Bavencio®), Durvalumab (Imfimzi®), cemiplimab-rwlc (Libtayo®), tislelizumab, and/or spartalizumab.

In some embodiments, the one or more additional therapeutic agents is a TIM-3 inhibitor, optionally wherein the TIM-3 inhibitor is MGB453 or TSR-022.

In some embodiments, the one or more additional therapeutic agents is a LAG-3 inhibitor, optionally wherein the LAG-3 inhibitor is selected from the group consisting of LAG525, BMS-986016, and TSR-033.

In some embodiments, the one or more additional therapeutic agents is a TIGIT inhibitor. In some embodiments, the one or more additional therapeutic agents is a CD112R inhibitor. In some embodiments, the one or more additional therapeutic agents is a TAM (Axl, Mer, Tyro) inhibitor. In some embodiments, the one or more additional therapeutic agents is a STING agonist. In some embodiments, the one or more additional therapeutic agents is a 4-1BB agonist.

Combination with Chemotherapeutic Agents

Chemotherapeutic agents suitable for combination and/or co-administration with compositions of the present invention include, for example: taxol, cytochalasin B, gramicidin D, ethidium bromide, emetine, mitomycin, etoposide, tenoposide, vincristine, vinblastine, colchicin, doxorubicin, daunorubicin, dihydroxyanthrancindione, mitoxantrone, mithramycin, actinomycin D, 1-dehydrotestosterone, glucocorticoids, procaine, tetracaine, lidocaine, propranolol, and puromycin and analogs or homologs thereof. Further agents include, for example, antimetabolites (e.g., methotrexate, 6-mercaptopurine, 6-thioguanine, cytarabine, 5-fluorouracil decarbazine), alkylating agents (e.g. mechlorethamine, thio-TEPA, chlorambucil, melphalan, carmustine (BSNU), lomustine (CCNU), cyclophosphamide, busulfan, dibromomannitol, streptozotocin, mitomycin C, cis-dichlordiamine platinum (II)(DDP), procarbazine, altretamine, cisplatin, carboplatin, oxaliplatin, nedaplatin, satraplatin, or triplatin tetranitrate), anthracycline (e.g. daunorubicin (formerly daunomycin) and doxorubicin), antibiotics (e.g. dactinomcin (formerly actinomycin), bleomycin, mithramycin, and anthramycin (AMC)), and anti-mitotic agents (e.g. vincristine and vinblastine) and temozolomide.

Combination with PD-1/PD-L1 Antagonists

In some embodiments, the anti-IL-27 antibodies, or antigen binding portions thereof, provided by the disclosure are combined (e.g., administered in combination) with one or more PD-1 antagonist that specifically binds to human PD-1 or PD-L1 and inhibits PD-1/PD-L1 biological activity and/or downstream pathway(s) and/or cellular processed mediated by human PD-1/PD-L1 signaling or other human PD-1/PD-L1-mediated functions.

Accordingly, provided herein are PD-1 antagonists that directly or allosterically block, antagonize, suppress, inhibit or reduce PD-1/PD-L1 biological activity, including downstream pathways and/or cellular processes mediated by PD-1/PD-L1 signaling, such as receptor binding and/or elicitation of a cellular response to PD-1/PD-L1. Also provided herein are PD-1 antagonists that reduce the quantity or amount of human PD-1 or PD-L1 produced by a cell or subject.

In some embodiments, the disclosure provides a PD-1 antagonist that binds human PD-1 and prevents, inhibits or reduces PD-L1 binding to PD-1. In some aspects, the PD-1 antagonist binds to the mRNA encoding PD-1 or PD-L1 and prevents translation. In some embodiments, the PD-1 antagonist binds to the mRNA encoding PD-1 or PD-L1 and causes degradation and/or turnover.

In some embodiments, the PD-1 antagonist inhibits PD-1 signaling or function. In some embodiments, the PD-1 antagonist blocks binding of PD-1 to PD-L1, PD-L2, or to both PD-L1 and PD-L2. In some embodiments, the PD-1 antagonist blocks binding of PD-1 to PD-L1. In some embodiments, the PD-1 antagonist blocks binding of PD-1 to PD-L2. In some embodiments, the PD-1 antagonist blocks the binding of PD-1 to PD-L1 and PD-L2. In some embodiments, the PD-1 antagonist specifically binds PD-1. In some embodiments, the PD-1 antagonist specifically binds PD-L1. In some embodiments, the PD-1 antagonist specifically binds PD-L2.

In some embodiments, the PD-1 antagonist inhibits the binding of PD-1 to its cognate ligand. In some embodiments, the PD-1 antagonist inhibits the binding of PD-1 to PD-L1, PD-1 to PD-L2, or PD-1 to both PD-L1 and PD-L2. In some embodiments, the PD-1 antagonist does not inhibit the binding of PD-1 to its cognate ligand.

In some embodiments, the PD-1 antagonist is an isolated monoclonal antibody (mAb), or antigen binding fragment thereof, which specifically binds to PD-1 or PD-L1. In some embodiments, the PD-1 antagonist is an antibody or antigen binding fragment thereof that specifically binds to human PD-1. In some embodiments, the PD-1 antagonist is an antibody or antigen binding fragment thereof that specifically binds to human PD-L1. In some embodiments, the PD-1 antagonist is an antibody or antigen binding fragment that binds to human PD-L1 and inhibits the binding of PD-L1 to PD-1. In some embodiments, the PD-1 antagonist is an antibody or antigen binding fragment that binds to human PD-1 and inhibits the binding of PD-L1 to PD-1.

Several immune checkpoint antagonists that inhibit or disrupt the interaction between PD-1 and either one or both of its ligands PD-L1 and PD-L2 are in clinical development or are currently available to clinicians for treating cancer.

Examples of anti-human PD-1 monoclonal antibodies, or antigen binding fragments thereof, that may comprise the PD-1 antagonist in any of the compositions, methods, and uses provided by the disclosure include, but are not limited to: KEYTRUDA® (pembrolizumab, MK-3475, h409A11; see U.S. Pat. Nos. 8,952,136, 8,354,509, 8,900,587, and EP2170959, all of which are included herein by reference in their entirety; Merck), OPDIVO® (nivolumab, BMS-936558, MDX-1106, ONO-4538; see U.S. Pat. Nos. 7,595,048, 8,728,474, 9,073,994, 9,067,999, EP1537878, U.S. Pat. Nos. 8,008,449, 8,779,105, and EP2161336, all of which are included herein by reference in their entirety; Bristol Myers Squibb), MEDI0680 (AMP-514), BGB-A317 and BGB-108 (BeiGene), 244C8 and 388D4 (see WO2016106159, which is incorporated herein by reference in its entirety; Enumeral Biomedical), PDR001 (Novartis), and REGN2810 (Regeneron). Accordingly, in some embodiments the PD-1 antagonist is pembrolizumab. In some embodiments, the PD-1 antagonist is nivolumab.

Examples of anti-human PD-L1 monoclonal antibodies, or antigen binding fragments thereof, that may comprise the PD-1 antagonist in any of the compositions, methods, and uses provided by the disclosure include, but are not limited to: BAVENCIO® (avelumab, MSB0010718C, see WO2013/79174, which is incorporated herein by reference in its entirety; Merck/Pfizer), IMFINZI® (durvalumab, MEDI4736), TECENTRIQ® (atezolizumab, MPDL3280A, RG7446; see WO2010/077634, which is incorporated herein by reference in its entirety; Roche), MDX-1105 (BMS-936559, 12A4; see U.S. Pat. No. 7,943,743 and WO2013/173223, both of which are incorporated herein by reference in their entirety; Medarex/BMS), and FAZ053 (Novartis). Accordingly, in some embodiments the PD-1 antagonist is avelumab. In some embodiments, the PD-1 antagonist is durvalumab. In some embodiments, the PD-1 antagonist is atezolizumab.

In some embodiments, the PD-1 antagonist is an immunoadhesin that specifically bind to human PD-1 or human PD-L1, e.g., a fusion protein containing the extracellular or PD-1 binding portion of PD-L1 or PD-L2 fused to a constant region such as an Fc region of an immunoglobulin molecule. Examples of immunoadhesion molecules that specifically bind to PD-1 are described in WO2010/027827 and WO2011/066342, both of which are incorporated herein by reference in their entirety. In some embodiments, the PD-1 antagonist is AMP-224 (also known as B7-DCIg), which is a PD-L2-FC fusion protein that specifically binds to human PD-1.

It will be understood by one of ordinary skill that any PD-1 antagonist which binds to PD-1 or PD-L1 and disrupts the PD-1/PD-L1 signaling pathway, is suitable for compositions, methods, and uses disclosed herein.

In some embodiments, the PD-1/PD-L1 antagonist is a small molecule, a nucleic acid, a peptide, a peptide mimetic, a protein, a carbohydrate, a carbohydrate derivative, or a glycopolymer. Exemplary small molecule PD-1 inhibitors are described in Zhan et al., (2016) Drug Discov Today 21(6):1027-1036.

Combinations with TIM-3 Inhibitors

In some embodiments, an anti-IL-27 antibody, or antigen binding portion thereof, provided by the disclosure is combined (e.g., administered in combination) with a TIM-3 inhibitor. The TIM-3 inhibitor may be an antibody, an antigen binding fragment thereof, an immunoadhesin, a fusion protein, or an oligopeptide. In some embodiments, the TIM-3 inhibitor is chosen from MGB453 (Novartis), TSR-022 (Tesaro), or LY3321367 (Eli Lilly). In some embodiments, the anti-IL-27 antibody, or antigen binding portion thereof, is administered in combination with MGB453. In some embodiments, the anti-IL-27 antibody, or antigen binding portion thereof, is administered in combination with TSR-022.

Combinations with LAG-3 Inhibitors

In some embodiments, an anti-IL-27 antibody, or antigen binding portion thereof, provided by the disclosure is combined (e.g., administered in combination) with a LAG-3 inhibitor. The LAG-3 inhibitor may be an antibody, an antigen binding fragment thereof, an immunoadhesin, a fusion protein, or oligopeptide. In some embodiments, the LAG-3 inhibitor is chosen from LAG525 (Novartis), BMS-986016 (Bristol-Myers Squibb), TSR-033 (Tesaro), MK-4280 (Merck & Co), or REGN3767 (Regeneron).

Other Combinations

In some embodiments, an anti-IL-27 antibody, or antigen binding portion thereof, provided by the disclosure is combined (e.g., administered in combination) with a TIGIT inhibitor, a kinase inhibitor (e.g., a tyrosine kinase inhibitor (TKI)), a CD112R inhibitor, a TAM receptor inhibitor, a STING agonist and/or a 4-1BB agonist, a CTLA-4 inhibitor, a CD73 inhibitor, a CD39 inhibitor, an A2AR inhibitor, an IDO inhibitor, NEKTAR, peg-IL-2, peg IL-10, a CD40 agonist, or a combination thereof.

Methods of Detection

In some embodiments, an anti-IL-27 antibody or an antigen-binding fragment thereof described herein can be employed in methods of detection and/or quantification of human IL-27 in a biological sample. Accordingly, an anti-IL-27 antibody, or an antigen-binding fragment thereof, as described herein is useful to diagnose, prognose and/or determine progression of disease (e.g., cancer) in a patient.

Monitoring a subject (e.g., a human patient) for an improvement in a cancer, as defined herein, means evaluating the subject for a change in a disease parameter, e.g., a reduction in tumor growth. In some embodiments, the evaluation is performed at least one (1) hour, e.g., at least 2, 4, 6, 8, 12, 24, or 48 hours, or at least 1 day, 2 days, 4 days, 10 days, 13 days, 20 days or more, or at least 1 week, 2 weeks, 4 weeks, 10 weeks, 13 weeks, 20 weeks or more, after an administration. The subject can be evaluated in one or more of the following periods: prior to beginning of treatment; during the treatment; or after one or more elements of the treatment have been administered. Evaluation can include evaluating the need for further treatment, e.g., evaluating whether a dosage, frequency of administration, or duration of treatment should be altered. It can also include evaluating the need to add or drop a selected therapeutic modality, e.g., adding or dropping any of the treatments for a cancer described herein.

In some embodiments, the disclosure provides a method of detecting IL-27 in a sample from a subject, the method comprising the (a) contacting a sample from the subject with a detection antibody under conditions to permit the detection antibody to form a detection antibody-IL-27 complex, if IL-27 is present in the sample, wherein the detection antibody is an antibody, or antigen binding fragment thereof, provided by the disclosure; and (b) detecting the presence of the complex, if any, produced in step (a).

In some embodiments, the disclosure provides a method of detecting an IL-27-associated cancer in a subject, the method comprising the steps of: (a) contacting a sample from a subject suspected of having an IL-27-associated cancer with a detection antibody under conditions to permit the detection antibody to form a detection antibody-IL-27 complex, if IL-27 is present in the sample, wherein the detection antibody is an antibody, or antigen binding portion thereof, provided by the disclosure; and (b) detecting the presence of the complex, if any, produced in step (a). In some embodiments, the detection antibody is coupled to a detectable label. In some embodiments, the method further comprises contacting the sample with a capture antibody to produce a complex comprising IL-27 and the capture antibody, if IL-27 is present in the sample, wherein the capture antibody is an antibody, or antigen binding portion thereof, provided by the disclosure.

In some embodiments, the capture antibody is immobilized on a solid support. In some embodiments, the sample is contacted with the capture antibody before the detection antibody. In some embodiments, the sample is a body fluid sample. In some embodiments, the fluid sample is blood, serum, plasma, cell lysates or tissue lysates.

In some embodiments, the cancer is selected from renal cell carcinoma (RCC), hepatocellular carcinoma, lung cancer, gastroesophageal cancer, ovarian cancer, endometrial cancer, melanoma, leukemia and lymphoma. In some embodiments, the cancer is renal cell carcinoma (RCC). In other embodiments, the cancer is hepatocellular carcinoma (HCC). In some embodiments, the cancer is selected from leukemia and lymphoma. In some embodiments, the cancer is acute myeloid leukemia (AML).

EXAMPLES

While the present disclosure has been described with reference to the specific embodiments thereof, it should be understood by those skilled in the art that various changes may be made and equivalents may be substituted without departing from the true spirit and scope of the disclosure. In addition, many modifications may be made to adapt a particular situation, material, composition of matter, process, process step or steps, to the objective, spirit and scope of the present disclosure. All such modifications are intended to be within the scope of the disclosure.

Example 1: Generation and Characterization of Anti-IL-27 Antibodies that Specifically Bind the IL-27 EBI3 Monomer This Example describes the production of anti-IL-27 antibodies that specifically bind to the EBI3 subunit of human IL-27. Briefly, BALB/c mice were immunized with a human EBI3 immunization vector (Aldevron) and used in the generation and isolation of hybridomas expressing anti-EBI3 monoclonal antibodies. Isolated hybridomas included hybridomas expressing anti-IL-27 antibody molecules referred to herein as Ab1, Ab2, Ab3, Ab4, Abs, Ab6, Ab7, and Ab8. Hybridoma supernatants were analyzed by flow cytometry on mammalian cells expressing a surface-targeted human EBI3. All the hybridoma clone supernatants tested bound to EBI3 expressing cells (data not shown).

An exemplary isolated anti-EBI3 antibody Ab7 (hereafter referred to as "Ab7", comprising an immunoglobulin heavy chain variable region hereafter referred to as "Ab7-$V_{H0}$" and an immunoglobulin light chain variable region hereafter referred to as "Ab7-$V_{L0}$") was sequenced and further characterized below (amino terminal signal peptide sequences are not shown).

The heavy chain variable region of the isolated Ab7 antibody (Ab7-$V_{H0}$) has the following sequence (FR1-CDR1-FR2-CDR2-FR3-CDR3-FR4-Constant region):

(SEQ ID NO: 1)
EVKLVESGGGLVQPGGSLKLFCAASGFTFTSYSMSWVRQTPEKRLEWVA
YISYDGGSAYYPDTVKGRFSISRDNAKKTLYLQMSSLKSEDTAMYYCAR
HGDYDDDDAMDYWGQGTSVTVSS.

A nucleic acid sequence encoding the heavy chain variable region Ab7-V$_{H0}$ has the following sequence (FR1-CDR1-FR2-CDR2-FR3-CDR3-FR4):

(SEQ ID NO: 2)
GAGGTGAAGCTGGTGGAGTCTGGGGGAGGCTTGGTACAGCCTGGGGGGT

CCCTGAAACTCTTCTGTGCAGCCTCTGGATTCACCTTTACCAGCTATTC

CATGAGCTGGGTCCGCCAGACTCCAGAGAAGAGGCTGGAGTGGGTCGCA

TACATTAGTTATGATGGTGGTAGCGCCTACTACCCTGACACTGTGAAGG

GCCGGTTCTCCATCTCCAGAGACAATGCCAAGAAAACCCTGTATCTGCA

AATGAGCAGCCTGAAGTCTGAGGACACGGCCATGTATTACTGTGCAAGA

CATGGAGACTATGACGACGACGACGCGATGGACTACTGGGGCCAAGGAA

CCTCAGTCACCGTCTCCTCA.

The light chain variable region of the isolated Ab7 antibody (Ab7-Wo) has the following sequence (FR1-CDR1-FR2-CDR2-FR3-CDR3-FR4-Constant region):

(SEQ ID NO: 3)
DIQMTQSPASLSASVGETVTITCRASENIYSYLAWYQQKQGKSPQLLVY
NAETLTEGVPSRFSGSGSGTQFSLKINSLQPEDFGNYYCQHHYGTPLTF
GAGTKLDLK.

The heavy chain of the isolated Ab7 antibody (Ab7-V$_{H0}$-mIgG2a) has the following sequence (FR1-CDR1-FR2-CDR2-FR3-CDR3-FR4-Constant region):

(SEQ ID NO: 183)
EVKLVESGGGLVQPGGSLKLFCAASGFTFT SYSMSWVRQTPEKRLEWVA

YISYDGGSAYYPDTVKGRFSISRDNAKKTLYLQMSSLKSEDTAMYYCAR

HGDYDDDDAMDYWGQGTSVTVSSAKTTAPSVYPLAPVCGDTTGSSVTLG

CLVKGYFPEPVTLTWNSGSLSSGVHTFPAVLQSDLYTLSSSVTVTSSTW

PSQSITCNVAHPASSTKVDKKIEPRGPTIKPCPPCKCPAPNLLGGPSVF

IFPPKIKDVLMISLSPIVTCVVVDVSEDDPDVQISWFVNNVEVHTAQTQ

THREDYNSTLRVVSALPIQHQDWMSGKEFKCKVNNKDLPAPIERTISKP

KGSVRAPQVYVLPPPEEEMTKKQVTLTCMVTDFMPEDIYVEWTNNGKTE

LNYKNTEPVLDSDGSYFMYSKLRVEKKNWVERNSYSCSVVHEGLHNHHT

TKSFSRTPGK.

A nucleic acid sequence encoding the light chain variable region Ab7-V$_{L0}$ has the following sequence (FR1-CDR1-FR2-CDR2-FR3-CDR3-FR4):

(SEQ ID NO: 4)
GACATCCAGATGACCCAGTCTCCAGCCTCCCTGTCTGCATCTGTAGGAG

AAACTGTCACCATCACTTGCCGGGCAAGTGAGAACATTTACAGCTATTT

AGCATGGTATCAGCAGAAACAGGGGAAATCTCCTCAGCTCCTGGTCTAT

AATGCAGAAACCTTGACAGAAGGGGTCCCATCAAGGTTCAGCGGCAGTG

GATCTGGGACACAATTCTCTCTCAAGATCAACAGTCTGCAACCTGAAGA

TTTTGGGAATTACTACTGTCAACATCATTACGGTACCCCGCTCACATTC

GGCGCTGGGACCAAGCTGGATCTGAAA.

The light chain of the isolated Ab7 antibody (Ab7-V$_{L0}$-mKappa) has the following sequence (FR1-CDR1-FR2-CDR2-FR3-CDR3-FR4-Constant region):

(SEQ ID NO: 184)
DIQMTQSPASLSASVGETVTITCRASENIYSYLAWYQQKQGKSPQLLVY

NAETLTEGVPSRFSGSGSGTQFSLKINSLQPEDFGNYYCQHHYGTPLTF

GAGTKLDLK*ADAAPTVSIFPPSSEQLTSGGASVVCFLNNFYPKDINVKW*

*KIDGSERONGVLNSWTDQDSKDSTYSMSSTLTLTKDEYERHNSYTCEAT*

*HKTSTSPIVKSFNRNEC*.

Humanized Ab7 antibodies were designed using methods known in the art. Briefly, the V region gene sequences encoding the mouse monoclonal Ab7 antibody were used to construct a series of fully humanized antibodies. Variable region genes were cloned into vectors encoding a human IgG1 heavy chain constant domain and a human kappa light chain constant domain. Chimeric and humanized antibodies were transiently expressed in mammalian cells. Humanization of the isolated Ab7 heavy chain variable region resulted in 5 humanized heavy chain variable region variants (hereafter referred to as "Ab7-V$_{H1}$," "Ab7-V$_{H2}$," "Ab7-V$_{H3}$," "Ab7-V$_{H4}$," and "Ab7-V$_{H5}$"). Humanization of the isolated Ab7 light chain variable region resulted in 4 humanized light chain variable region variants (hereafter referred to as "Ab7-V$_{L1}$," "Ab7-V$_{L2}$," "Ab7-V$_{L3}$," and "Ab7-V$_{L4}$").

The protein sequences defining the humanized Ab7 variant variable regions, and nucleotide sequences encoding the humanized Ab7 variant variable regions, are summarized below (amino terminal signal peptide sequences are not shown).

The heavy chain variable region Ab7-V$_{H1}$ has the following sequence (FR1-CDR1-FR2-CDR2-FR3-CDR3-FR4):

(SEQ ID NO: 5)
EVKLVESGGGLVQPGGSLRLSCAASGFTFT SYSMSWVRQAPGKGLEWVA
YISYDGGSAYYPDTVKGRFTISRDNSKKTLYLQMSSLKSEDTAMYYCAR
HGDYDDDDAMDYWGQGTSVTVSS.

A nucleic acid sequence encoding the heavy chain variable region Ab7-V$_{H1}$ has the following sequence (FR1-CDR1-FR2-CDR2-FR3-CDR3-FR4):

(SEQ ID NO: 6)
GAGGTGAAGCTGGTGGAGTCTGGGGGAGGCTTGGTACAGCCTGGGGGGT

CCCTGAGACTCTCCTGTGCAGCCTCTGGATTCACCTTTACCAGCTATTC

CATGAGCTGGGTCCGCCAGGCTCCAGGGAAGGGGCTGGAGTGGGTCGCA

TACATTAGTTATGATGGTGGTAGCGCCTACTACCCTGACACTGTGAAGG

GCCGGTTCACCATCTCCAGAGACAATTCCAAGAAAACCCTGTATCTGCA

AATGAGCAGCCTGAAGTCTGAGGACACGGCCATGTATTACTGTGCAAGA

CATGGAGACTATGACGACGACGACGCGATGGACTACTGGGGCCAAGGAA

CCTCAGTCACCGTCTCCTCA.

The heavy chain variable region Ab7-V$_{H2}$ has the following sequence (FR1-CDR1-FR2-CDR2-FR3-CDR3-FR4):

(SEQ ID NO: 7)
EVQLVESGGGLVQPGGSLRLSCAASGFTFTSYSMSWVRQAPGKGLEWVA
YISYDGGSAYYPDTVKGRFTISRDNSKNTLYLQMSSLKSEDTAMYYCAR
HGDYDDDDAMDYWGQGTLVTVSS.

A nucleic acid sequence encoding the heavy chain variable region Ab7-V$_{H2}$ has the following sequence (FR1-CDR1-FR2-CDR2-FR3-CDR3-FR4):

(SEQ ID NO: 8)
GAGGTGCAGCTGGTGGAGTCTGGGGGAGGCTTGGTACAGCCTGGGGGT

CCCTGAGACTCTCCTGTGCAGCCTCTGGATTCACCTTTACCAGCTATTC

CATGAGCTGGGTCCGCCAGGCTCCAGGGAAGGGGCTGGAGTGGGTCGCA

TACATTAGTTATGATGGTGGTAGCGCCTACTACCCTGACACTGTGAAGG

GCCGGTTCACCATCTCCAGAGACAATTCCAAGAACACCCTGTATCTGCA

AATGAGCAGCCTGAAGTCTGAGGACACGGCCATGTATTACTGTGCAAGA

CATGGAGACTATGACGACGACGACGCGATGGACTACTGGGGCCAAGGAA

CCCTGGTCACCGTCTCCTCA.

The heavy chain variable region Ab7-V$_{H3}$ has the following sequence (FR1-CDR1-FR2-CDR2-FR3-CDR3-FR4):

(SEQ ID NO: 9)
EVKLVESGGGLVQPGGSLRLSCAASGFTFTSYSMSWVRQAPGKGLEWVA
YISYDGGSAYYPDTVKGRFTISRDNSKKTLYLQMNSLRAEDTAVYYCAR
HGDYDDDDAMDYWGQGTLVTVSS.

A nucleic acid sequence encoding the heavy chain variable region Ab7-V$_{H3}$ has the following sequence (FR1-CDR1-FR2-CDR2-FR3-CDR3-FR4):

(SEQ ID NO: 10)
GAGGTGAAGCTGGTGGAGTCTGGGGGAGGCTTGGTACAGCCTGGGGGT

CCCTGAGACTCTCCTGTGCAGCCTCTGGATTCACCTTTACCAGCTATTC

CATGAGCTGGGTCCGCCAGGCTCCAGGGAAGGGGCTGGAGTGGGTCGCA

TACATTAGTTATGATGGTGGTAGCGCCTACTATCCTGACACTGTGAAGG

GCCGGTTCACCATCTCCAGAGACAATTCCAAGAAAACCCTGTATCTGCA

AATGAACAGCCTGAGAGCCGAGGACACGGCCGTATATTACTGTGCAAGA

CATGGAGACTATGACGACGACGACGCGATGGACTACTGGGGCCAAGGAA

CCCTGGTCACCGTCTCCTCA.

The heavy chain variable region Ab7-V$_{H4}$ has the following sequence (FR1-CDR1-FR2-CDR2-FR3-CDR3-FR4):

(SEQ ID NO: 11)
EVQLVESGGGLVQPGGSLRLSCAASGFTFTSYSMSWVRQAPGKGLEWVA
YISYDGGSAYYPDTVKGRFTISRDNSKNTLYLQMNSLRAEDTAVYYCAR
HGDYDDDDAMDYWGQGTLVTVSS.

A nucleic acid sequence encoding the heavy chain variable region Ab7-V$_{H4}$ has the following sequence (FR1-CDR1-FR2-CDR2-FR3-CDR3-FR4):

(SEQ ID NO: 12)
GAGGTGCAGCTGGTGGAGTCTGGGGGAGGCTTGGTACAGCCTGGGGGT

CCCTGAGACTCTCCTGTGCAGCCTCTGGATTCACCTTTACCAGCTATTC

CATGAGCTGGGTCCGCCAGGCTCCAGGGAAGGGGCTGGAGTGGGTCGCA

TACATTAGTTATGATGGTGGTAGCGCCTACTATCCTGACACTGTGAAGG

GCCGGTTCACCATCTCCAGAGACAATTCCAAGAACACCCTGTATCTGCA

AATGAACAGCCTGAGAGCCGAGGACACGGCCGTATATTACTGTGCAAGA

CATGGAGACTATGACGACGACGACGCGATGGACTACTGGGGCCAAGGAA

CCCTGGTCACCGTCTCCTCA.

The heavy chain variable region Ab7-V$_{H5}$ has the following sequence (FR1-CDR1-FR2-CDR2-FR3-CDR3-FR4):

(SEQ ID NO: 13)
EVQLVESGGGLVQPGGSLRLSCAASGFTFTSYSMSWVRQAPGKGLEWVS
YISYDGGSAYYPDTVKGRFTISRDNSKNTLYLQMNSLRAEDTAVYYCAR
HGDYDDDDAMDYWGQGTLVTVSS.

A nucleic acid sequence encoding the heavy chain variable region Ab7-V$_{H5}$ has the following sequence (FR1-CDR1-FR2-CDR2-FR3-CDR3-FR4):

(SEQ ID NO: 14)
GAGGTGCAGCTGGTGGAGTCTGGGGGAGGCTTGGTACAGCCTGGGGGT

CCCTGAGACTCTCCTGTGCAGCCTCTGGATTCACCTTTACCAGCTATTC

CATGAGCTGGGTCCGCCAGGCTCCAGGGAAGGGGCTGGAGTGGGTGTCT

TACATTAGTTATGATGGTGGTAGCGCCTACTATCCTGACACTGTGAAGG

GCCGGTTCACCATCTCCAGAGACAATTCCAAGAACACCCTGTATCTGCA

AATGAACAGCCTGAGAGCCGAGGACACGGCCGTATATTACTGTGCAAGA

CATGGAGACTATGACGACGACGACGCGATGGACTACTGGGGCCAAGGAA

CCCTGGTCACCGTCTCCTCA.

The light chain variable region Ab7-V$_{L1}$ has the following sequence (FR1-CDR1-FR2-CDR2-FR3-CDR3-FR4):

(SEQ ID NO: 15)
DIQMTQSPSSLSASVGDRVTITCRASENIYSYLAWYQQKQGKAPKLLVY
NAETLTEGVPSRFSGSGSGTDFTLTISSLQPEDFANYYCQHHYGTPLTF
GQGTKLDIK.

A nucleic acid sequence encoding the light chain variable region Ab7-V$_{L1}$ has the following sequence (FR1-CDR1-FR2-CDR2-FR3-CDR3-FR4):

(SEQ ID NO: 16)
GACATCCAGATGACCCAGTCTCCATCCTCCCTGTCTGCATCTGTAGGAG

ACAGAGTCACCATCACTTGCCGGGCAAGTGAGAACATTTACAGCTATTT

AGCATGGTATCAGCAGAAACAGGGGAAAGCCCCTAAGCTCCTGGTCTAT

AATGCAGAAACCTTGACAGAAGGGGTCCCATCAAGGTTCAGCGGCAGTG

GATCTGGGACAGATTTCACTCTCACCATCAGCAGTCTGCAACCTGAAGA

TTTTGCAAATTACTACTGTCAACATCATTACGGTACCCCGCTCACATTC

GGCCAAGGGACCAAGCTGGATATCAAA.

The light chain variable region Ab7-V$_{L2}$ has the following sequence (FR1-CDR1-FR2-CDR2-FR3-CDR3-FR4):

(SEQ ID NO: 17)
DIQMTQSPSSLSASVGDRVTITCRASENIYSYLAWYQQKPGKAPKLLVY
NAETLTEGVPSRFSGSGSGTDFTLTISSLQPEDFANYYCQHHYGTPLTF
GQGTKLEIK.

A nucleic acid sequence encoding the light chain variable region Ab7-V$_{L2}$ has the following sequence (FR1-CDR1-FR2-CDR2-FR3-CDR3-FR4):

(SEQ ID NO: 18)
GACATCCAGATGACCCAGTCTCCATCCTCCCTGTCTGCATCTGTAGGAG

ACAGAGTCACCATCACTTGCCGGGCAAGTGAGAACATTTACAGCTATTT

AGCATGGTATCAGCAGAAACCAGGGAAAGCCCCTAAGCTCCTGGTCTAT

AATGCAGAAACCTTGACAGAAGGGGTCCCATCAAGGTTCAGCGGCAGTG

GATCTGGGACAGATTTCACTCTCACCATCAGCAGTCTGCAACCTGAAGA

TTTTGCAAATTACTACTGTCAACATCATTACGGTACCCCGCTCACATTC

GGCCAAGGGACCAAGCTGGAAATCAAA.

The light chain variable region Ab7-V$_{L3}$ has the following sequence (FR1-CDR1-FR2-CDR2-FR3-CDR3-FR4):

(SEQ ID NO: 19)
DIQMTQSPSSLSASVGDRVTITCRASENIYSYLAWYQQKPGKAPKLLVY
NAETLTEGVPSRFSGSGSGTDFTLTISSLQPEDFATYYCQHHYGTPLTF
GQGTKLEIK.

A nucleic acid sequence encoding the light chain variable region Ab7-V$_{L3}$ has the following sequence (FR1-CDR1-FR2-CDR2-FR3-CDR3-FR4):

(SEQ ID NO: 20)
GACATCCAGATGACCCAGTCTCCATCCTCCCTGTCTGCATCTGTAGGAG

ACAGAGTCACCATCACTTGCCGGGCAAGTGAGAACATTTACAGCTATTT

AGCATGGTATCAGCAGAAACCAGGGAAAGCCCCTAAGCTCCTGGTCTAT

AATGCAGAAACCTTGACAGAAGGGGTCCCATCAAGGTTCAGCGGCAGTG

GATCTGGGACAGATTTCACTCTCACCATCAGCAGTCTGCAACCTGAAGA

TTTTGCAACTTACTACTGTCAACATCATTACGGTACCCCGCTCACATTC

GGCCAAGGGACCAAGCTGGAAATCAAA.

The light chain variable region Ab7-V$_{L4}$ has the following sequence (FR1-CDR1-FR2-CDR2-FR3-CDR3-FR4):

(SEQ ID NO: 21)
DIQMTQSPSSLSASVGDRVTITCRASENIYSYLNWYQQKPGKAPKLLVY
NAETLTEGVPSRFSGSGSGTDFTLTISSLQPEDFATYYCQHHYGTPLTF
GQGTKLEIK.

A nucleic acid sequence encoding the light chain variable region Ab7-V$_{L4}$ has the following sequence (FR1-CDR1-FR2-CDR2-FR3-CDR3-FR4):

(SEQ ID NO: 22)
GACATCCAGATGACCCAGTCTCCATCCTCCCTGTCTGCATCTGTAGGAG

ACAGAGTCACCATCACTTGCCGGGCAAGTGAGAACATTTACAGCTATTT

AAATTGGTATCAGCAGAAACCAGGGAAAGCCCCTAAGCTCCTGGTCTAT

AATGCAGAAACCTTGACAGAAGGGGTCCCATCAAGGTTCAGCGGCAGTG

GATCTGGGACAGATTTCACTCTCACCATCAGCAGTCTGCAACCTGAAGA

TTTTGCAACTTACTACTGTCAACATCATTACGGTACCCCGCTCACATTC

GGCCAAGGGACCAAGCTGGAAATCAAA.

The heavy chain and light chain CDR amino acid sequences of the isolated parental Ab7 antibody (Kabat definition) are shown in Table 1.

TABLE 1

| Heavy Chain Variable Region | HCDR1 | HCDR2 | HCDR3 |
|---|---|---|---|
| Ab7-V$_{H0}$ (SEQ ID NO: 16) | SYSMS (SEQ ID NO: 23) | YISYDGGSAYYPDTVKG (SEQ ID NO: 24) | HGDYDDDDAMDY (SEQ ID NO: 25) |
| Light Chain Variable Region | LCDR1 | LCDR2 | LCDR3 |
| Ab7-V$_{L0}$ (SEQ ID NO: 29) | RASENIYSYLA (SEQ ID NO: 26) | NAETLTE (SEQ ID NO: 27) | QHHYGTPLT (SEQ ID NO: 28) |

To create the complete chimeric and humanized heavy or light chain antibody sequences, each heavy chain variable region described above was combined with a human IgG1 constant region, and each light chain variable region described above was combined a human kappa constant region.

The protein sequences defining the complete heavy chain and light chain of the chimeric and humanized Ab7 variants are summarized below (amino terminal signal peptide sequences are not shown).

The heavy chain Ab7-V$_{H0}$-IgG1 has the following sequence (FR1-CDR1-FR2-CDR2-FR3-CDR3-FR4-Constant region):

(SEQ ID NO: 29)
EVKLVESGGGLVQPGGSLKLFCAASGFTFTSYSMSWVRQTPEKRLEWVA
YISYDGGSAYYPDTVKGRFSISRDNAKKTLYLQMSSLKSEDTAMYYCAR
HGDYDDDDAMDYWGQGTSVTVSSASTKGPSVFPLAPSSKSTSGGTAALG
CLVKDYFPEPVTVSWNSGALTSGVHTFPAVLQSSGLYSLSSVVTVPSSS
LGTQTYICNVNHKPSNTKVDKKVEPKSCDKTHTCPPCPAPELLGGPSVF
LFPPKPKDTLMISRTPEVTCVVVDVSHEDPEVKFNWYVDGVEVHNAKTK
PREEQYNSTYRVVSVLTVLHQDWLNGKEYKCKVSNKALPAPIEKTISKA
KGQPREPQVYTLPPSRDELTKNOVSLTCLVKGFYPSDIAVEWESNGQPE
NNYKTTPPVLDSDGSFFLYSKLTVDKSRWQQGNVFSCSVMHEALHNHYT
QKSLSLSPGK.

A nucleic acid sequence encoding the heavy chain Ab7-V$_{H0}$-IgG1 has the following sequence (FR1-CDR1-FR2-CDR2-FR3-CDR3-FR4-Constant region):

(SEQ ID NO: 30)
GAGGTGAAGCTGGTGGAGTCTGGGGGAGGCTTGGTACAGCCTGGGGGGTCCCTGAAACTCTTCT
GTGCAGCCTCTGGATTCACCTTTACCAGCTATTCCATGAGCTGGGTCCGCCAGACTCCAGAGAA
GAGGCTGGAGTGGGTCGCATACATTAGTTATGATGGTGGTAGCGCCTACTACCCTGACACTGTG
AAGGGCCGGTTCTCCATCTCCAGAGACAATGCCAAGAAAACCCTGTATCTGCAAATGAGCAGCC
TGAAGTCTGAGGACACGGCCATGTATTACTGTGCAAGACATGGAGACTATGACGACGACGACGC
GATGGACTACTGGGGCCAAGGAACCTCAGTCACCGTCTCCTCAGCCTCCACCAAAGGCCCCAGC
GTCTTCCCCCTCGCGCCGTCCTCCAAGTCCACCTCGGGTGGCACCGCCGCCCTGGGCTGCCTGG
TCAAGGACTACTTCCCGGAGCCTGTGACCGTGTCCTGGAACTCGGGCGCGCTCACGAGCGGCGT
ACACACCTTCCCGGCGGTGCTCCAGTCCTCCGGGCTGTACTCGCTCTCGTCGTCGTCACGGTG
CCGTCCTCCTCCCTGGGCACCCAGACCTACATCTGCAACGTGAACCACAAGCCGTCCAACACCA
AGGTGGATAAGAAGGTCGAGCCCAAGTCGTGCGACAAGACGCACACGTGCCCGCCGTGCCCGGC
CCCGGAGCTGCTGGGCGGCCCCTCGGTCTTCCTGTTCCCCCCGAAGCCCAAGGATACGCTGATG
ATCTCCCGCACCCCGGAGGTCACCTGCGTGGTGGTGGACGTCTCCCACGAGGACCCGGAGGTGA
AATTCAACTGGTACGTCGACGGAGTGGAGGTCCAACGCCAAGACCAAGCCCCGGGAGGAGCA
GTACAACTCCACGTACCGCGTCGTCTCCGTCCTGACCGTCCTCCACCAGGACTGGCTGAACGGC
AAGGAGTACAAGTGTAAGGTCTCCAACAAGGCGCTGCCCGCCCCCATCGAGAAGACCATCTCCA
AGGCAAAGGGTCAGCCGCGGGAGCCGCAGGTCTATACCCTCCCCCCGTCCCGCGACGAGCTGAC
GAAAAACCAGGTCTCCCTGACCTGCCTGGTGAAGGGTTTCTACCCCTCCGACATCGCGGTCGAG
TGGGAGTCGAACGGCCAGCCGGAGAACAACTACAAGACCACCCCCCCCGTGCTCGACAGTGACG
GCTCGTTCTTCCTGTACTCGAAGCTGACCGTCGACAAGTCGCGCTGGCAGCAGGGCAACGTCTT
CTCGTGCTCCGTTATGCACGAGGCCCTGCACAACCACTACACGCAGAAGAGTCTTTCGCTGTCC
CCGGGGAAGTGA.**

The heavy chain Ab7-V$_{H1}$-IgG1 has the following sequence (FR1-CDR1-FR2-CDR2-FR3-CDR3-FR4-Constant region):

(SEQ ID NO: 31)
EVKLVESGGGLVQPGGSLRLSCAASGFTFTSYSMSWVRQAPGKGLEWVAYISYDGGSAYYPDTV
KGRFTISRDNSKKTLYLQMSSLKSEDTAMYYCARHGDYDDDDAMDYWGQGTSVTVSSASTKGPS
VFPLAPSSKSTSGGTAALGCLVKDYFPEPVTVSWNSGALTSGVHTFPAVLQSSGLYSLSSVVTV
PSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNG
KEYKCKVSNKALPAPIEKTISKAKGQPREPQVYTLPPSRDELTKNQVSLTCLVKGFYPSDIAVE

WESNGQPENNYKTTPPVLDSDGSFFLYSKLTVDKSRWQQGNVFSCSVMHEALHNHYTQKSLSLS

PGK.

A nucleic acid sequence encoding the heavy chain Ab7-V$_{H1}$-IgG1 has the following sequence (FR1-CDR1-FR2-CDR2-FR3-CDR3-FR4-Constant region):

(SEQ ID NO: 32)
GAGGTGAAGCTGGTGGAGTCTGGGGGAGGCTTGGTACAGCCTGGGGGGTCCCTGAGACTCTCCT

GTGCAGCCTCTGGATTCACCTTTACCAGCTATTCCATGAGCTGGGTCCGCCAGGCTCCAGGGAA

GGGGCTGGAGTGGGTCGCATACATTAGTTATGATGGTGGTAGCGCCTACTACCCTGACACTGTG

AAGGGCCGGTTCACCATCTCCAGAGACAATTCCAAGAAAACCCTGTATCTGCAAATGAGCAGCC

TGAAGTCTGAGGACACGGCCATGTATTACTGTGCAAGACATGGAGACTATGACGACGACGACGC

GATGGACTACTGGGGCCAAGGAACCTCAGTCACCGTCTCCTCAGCCTCCACCAAGGGCCCCAGC

GTCTTCCCCCTCGCGCCGTCCTCCAAGTCCACCTCGGGTGGCACCGCCGCCCTGGGCTGCCTGG

TCAAGGACTACTTCCCGGAGCCTGTGACCGTGTCCTGGAACTCGGGCGCGCTCACGAGCGGCGT

ACACACCTTCCCGGCGGTGCTCCAGTCCTCCGGGCTGTACTCGCTCTCGTCGGTCGTCACGGTG

CCGTCCTCCTCCCTGGGCACCCAGACCTACATCTGCAACGTGAACCACAAGCCGTCCAACACCA

AGGTGGATAAGAAGGTCGAGCCCAAGTCGTGCGACAAGACGCACACGTGCCCGCCGTGCCCGGC

CCCGGAGCTGCTGGGCGGCCCCTCGGTCTTCCTGTTCCCCCCGAAGCCCAAGGATACGCTGATG

ATCTCCCGCACCCCGGAGGTCACCTGCGTGGTGGTGGACGTCTCCCACGAGGACCCGGAGGTGA

AATTCAACTGGTACGTCGACGGAGTGGAGGTCCACAACGCCAAGACCAAGCCCCGGGAGGAGCA

GTACAACTCCACGTACCGCGTCGTCTCCGTCCTGACCGTCCTCCACCAGGACTGGCTGAACGGC

AAGGAGTACAAGTGTAAGGTCTCCAACAAGGCGCTGCCCGCCCCCATCGAGAAGACCATCTCCA

AGGCAAAGGGTCAGCCGCGGGAGCCGCAGGTCTATACCCTCCCCCCGTCCCGCGACGAGCTGAC

GAAAAACCAGGTCTCCCTGACCTGCCTGGTGAAGGGTTTCTACCCCTCCGACATCGCGGTCGAG

TGGGAGTCGAACGGCCAGCCGGAGAACAACTACAAGACCACCCCCCCCGTGCTCGACAGTGACG

GCTCGTTCTTCCTGTACTCGAAGCTGACCGTCGACAAGTCGCGCTGGCAGCAGGGCAACGTCTT

CTCGTGCTCCGTTATGCACGAGGCCCTGCACAACCACTACACGCAGAAGAGTCTTTCGCTGTCC

CCGGGGAAGTGA.

The heavy chain Ab7-V$_{H2}$-IgG1 has the following sequence (FR1-CDR1-FR2-CDR2-FR3-CDR3-FR4-Constant region):

(SEQ ID NO: 33)
EVQLVESGGGLVQPGGSLRLSCAASGFTFTSYSMSWVRQAPGKGLEWVAYISYDGGSAYYPDTV

KGRFTISRDNSKNTLYLQMSSLKSEDTAMYYCARHGDYDDDDAMDYWGQGTLVTVSSASTKGPS

VFPLAPSSKSTSGGTAALGCLVKDYFPEPVTVSWNSGALTSGVHTFPAVLQSSGLYSLSSVVTV

PSSSLGTQTYICNVNHKPSNTKVDKKVEPKSCDKTHTCPPCPAPELLGGPSVFLFPPKPKDTLM

ISRTPEVTCVVVDVSHEDPEVKFNWYVDGVEVHNAKTKPREEQYNSTYRVVSVLTVLHQDWLNG

KEYKCKVSNKALPAPIEKTISKAKGQPREPQVYTLPPSRDELTKNQVSLTCLVKGFYPSDIAVE

WESNGQPENNYKTTPPVLDSDGSFFLYSKLTVDKSRWQQGNVFSCSVMHEALHNHYTQKSLSLS

PGK.

A nucleic acid sequence encoding the heavy chain Ab7-$V_{H2}$-IgG1 has the following sequence (FR1-CDR1-FR2-CDR2-FR3-CDR3-FR4-Constant region):

(SEQ ID NO: 34)

GAGGTGCAGCTGGTGGAGTCTGGGGGAGGCTTGGTACAGCCTGGGGGGTCCCTGAGACTCTCCT

GTGCAGCCTCTGGATTCACCTTTACCAGCTATTCCATGAGCTGGGTCCGCCAGGCTCCAGGGAA

GGGGCTGGAGTGGGTCGCATACATTAGTTATGATGGTGGTAGCGCCTACTACCCTGACACTGTG

AAGGGCCGGTTCACCATCTCCAGAGACAATTCCAAGAACACCCTGTATCTGCAAATGAGCAGCC

TGAAGTCTGAGGACACGGCCATGTATTACTGTGCAAGACATGGAGACTATGACGACGACGACGC

GATGGACTACTGGGGCCAAGGAACCCTGGTCACCGTCTCCTCAGCCTCCACCAAGGGCCCCAGC

*GTCTTCCCCCTCGCGCCGTCCTCCAAGTCCACCTCGGGTGGCACCGCCGCCCTGGGCTGCCTGG*

*TCAAGGACTACTTCCCGGAGCCTGTGACCGTGTCCTGGAACTCGGGCGCGCTCACGAGCGGCGT*

*ACACACCTTCCCGGCGGTGCTCCAGTCCTCCGGGCTGTACTCGCTCTCGTCGGTCGTCACGGTG*

*CCGTCCTCCTCCCTGGGCACCCAGACCTACATCTGCAACGTGAACCACAAGCCGTCCAACACCA*

*AGGTGGATAAGAAGGTCGAGCCCAAGTCGTGCGACAAGACGCACACGTGCCCGCCGTGCCCGGC*

*CCCGGAGCTGCTGGGCGGCCCCTCGGTCTTCCTGTTCCCCCCGAAGCCCAAGGATACGCTGATG*

*ATCTCCCGCACCCCGGAGGTCACCTGCGTGGTGGTGGACGTCTCCCACGAGGACCCGGAGGTGA*

*AATTCAACTGGTACGTCGACGGAGTGGAGGTCCACAACGCCAAGACCAAGCCCCGGGAGGAGCA*

*GTACAACTCCACGTACCGCGTCGTCTCCGTCCTGACCGTCCTCCACCAGGACTGGCTGAACGGC*

*AAGGAGTACAAGTGTAAGGTCTCCAACAAGGCGCTGCCCGCCCCCATCGAGAAGACCATCTCCA*

*AGGCAAAGGGTCAGCCGCGGGAGCCGCAGGTCTATACCCTCCCCCCGTCCCGCGACGAGCTGAC*

*GAAAAACCAGGTCTCCCTGACCTGCCTGGTGAAGGGTTTCTACCCCTCCGACATCGCGGTCGAG*

*TGGGAGTCGAACGGCCAGCCGGAGAACAACTACAAGACCACCCCCCCCGTGCTCGACAGTGACG*

*GCTCGTTCTTCCTGTACTCGAAGCTGACCGTCGACAAGTCGCGCTGGCAGCAGGGCAACGTCTT*

*CTCGTGCTCCGTTATGCACGAGGCCCTGCACAACCACTACACGCAGAAGAGTCTTTCGCTGTCC*

*CCGGGGAAGTGA.*

The heavy chain Ab7-$V_{H3}$-IgG1 has the following sequence (FR1-CDR1-FR2-CDR2-FR3-CDR3-FR4-Constant region):

(SEQ ID NO: 35)
EVKLVESGGGLVQPGGSLRLSCAASGFTFTSYSMSWVRQAPGKGLEWVAYISYDGGSAYYPDTV

KGRFTISRDNSKKTLYLQMNSLRAEDTAVYYCARHGDYDDDDAMDYWGQGTLVTVSS*ASTKGPS*

*VFPLAPSSKSTSGGTAALGCLVKDYFPEPVTVSWNSGALTSGVHTFPAVLQSSGLYSLSSVVTV*

*PSSSLGTQTYICNVNHKPSNTKVDKKVEPKSCDKTHTCPPCPAPELLGGPSVFLFPPKPKDTLM*

*ISRTPEVTCVVVDVSHEDPEVKFNWYVDGVEVHNAKTKPREEQYNSTYRVVSVLTVLHQDWLNG*

*KEYKCKVSNKALPAPIEKTISKAKGQPREPQVYTLPPSRDELTKNQVSLTCLVKGFYPSDIAVE*

*WESNGQPENNYKTTPPVLDSDGSFFLYSKLTVDKSRWQQGNVFSCSVMHEALHNHYTQKSLSLS*

*PGK.*

A nucleic acid sequence encoding the heavy chain Ab7-V$_{H3}$-IgG1 has the following sequence (FR1-CDR1-FR2-CDR2-FR3-CDR3-FR4-Constant region):

(SEQ ID NO: 36)
GAGGTGAAGCTGGTGGAGTCTGGGGGAGGCTTGGTACAGCCTGGGGGGTCCCTGAGACTCTCCT

GTGCAGCCTCTGGATTCACCTTTACCAGCTATTCCATGAGCTGGGTCCGCCAGGCTCCAGGGAA

GGGGCTGGAGTGGGTCGCATACATTAGTTATGATGGTGGTAGCGCCTACTATCCTGACACTGTG

AAGGGCCGGTTCACCATCTCCAGAGACAATTCCAAGAAAACCCTGTATCTGCAAATGAACAGCC

TGAGAGCCGAGGACACGGCCGTATATTACTGTGCAAGACATGGAGACTATGACGACGACGACGC

GATGGACTACTGGGGCCAAGGAACCCTGGTCACCGTCTCCTCAGCCTCCACCAAAGGCCCCAGC

GTCTTCCCCCTCGCGCCGTCCTCCAAGTCCACCTCGGGTGGCACCGCCGCCCTGGGCTGCCTGG

TCAAGGACTACTTCCCGGAGCCTGTGACCGTGTCCTGGAACTCGGGCGCGCTCACGAGCGGCGT

ACACACCTTCCCGGCGGTGCTCCAGTCCTCCGGGCTGTACTCGCTCTCGTCGGTCGTCACGGTG

CCGTCCTCCTCCCTGGGCACCCAGACCTACATCTGCAACGTGAACCACAAGCCGTCCAACACCA

AGGTGGATAAGAAGGTCGAGCCCAAGTCGTGCGACAAGACGCACACGTGCCCGCCGTGCCCGGC

CCCGGAGCTGCTGGGCGGCCCCTCGGTCTTCCTGTTCCCCCCGAAGCCCAAGGATACGCTGATG

ATCTCCCGCACCCCGGAGGTCACCTGCGTGGTGGTGGACGTCTCCCACGAGGACCCGGAGGTGA

AATTCAACTGGTACGTCGACGGAGTGGAGGTCCACAACGCCAAGACCAAGCCCCGGGAGGAGCA

GTACAACTCCACGTACCGCGTCGTCTCCGTCCTGACCGTCCTCCACCAGGACTGGCTGAACGGC

AAGGAGTACAAGTGTAAGGTCTCCAACAAGGCGCTGCCCGCCCCCATCGAGAAGACCATCTCCA

AGGCAAAGGGTCAGCCGCGGGAGCCGCAGGTCTATACCCTCCCCCCGTCCCGCGACGAGCTGAC

GAAAAACCAGGTCTCCCTGACCTGCCTGGTGAAGGGTTTCTACCCCTCCGACATCGCGGTCGAG

TGGGAGTCGAACGGCCAGCCGGAGAACAACTACAAGACCACCCCCCCCGTGCTCGACAGTGACG

GCTCGTTCTTCCTGTACTCGAAGCTGACCGTCGACAAGTCGCGCTGGCAGCAGGGCAACGTCTT

CTCGTGCTCCGTTATGCACGAGGCCCTGCACAACCACTACACGCAGAAGAGTCTTTCGCTGTCC

CCGGGGAAGTGA.

The heavy chain Ab7-V$_{H4}$-IgG1 has the following sequence (FR1-CDR1-FR2-CDR2-FR3-CDR3-FR4-Constant region):

(SEQ ID NO: 37)
EVQLVESGGGLVQPGGSLRLSCAASGFTFTSYSMSWVRQAPGKGLEWVAY

ISYDGGSAYYPDTVKGRFTISRDNSKNTLYLQMNSLRAEDTAVYYCARHG

DYDDDDDAMDYWGQGTLVTVSSASTKGPSVFPLAPSSKSTSGGTAALGCLV

KDYFPEPVTVSWNSGALTSGVHTFPAVLQSSGLYSLSSVVTVPSSSLGTQ

TYICNVNHKPSNTKVDKKVEPKSCDKTHTCPPCPAPELLGGPSVFLPPK

PKDTLMISRTPEVTCVVVDVSHEDPEVKFNWYVDGVEVHNAKTKPREEQY

NSTYRVVSVLTVLHQDWLNGKEYKCKVSNKALPAPIEKTISKAKGQPREP

QVYTLPPSRDELTKNQVSLTCLVKGFYPSDIAVEWESNGQPENNYKTTPP

VLDSDGSFFLYSKLTVDKSRWQQGNVFSCSVMHEALHNHYTQKSLSLSPG

K.

A nucleic acid sequence encoding the heavy chain Ab7-V$_{H4}$-IgG1 has the following sequence (FR1-CDR1-FR2-CDR2-FR3-CDR3-FR4-Constant region):

(SEQ ID NO: 38)
GAGGTGCAGCTGGTGGAGTCTGGGGGAGGCTTGGTACAGCCTGGGGGGTC

CCTGAGACTCTCCTGTGCAGCCTCTGGATTCACCTTTACCAGCTATTCCA

TGAGCTGGGTCCGCCAGGCTCCAGGGAAGGGGCTGGAGTGGGTCGCATAC

ATTAGTTATGATGGTGGTAGCGCCTACTATCCTGACACTGTGAAGGGCCG

GTTCACCATCTCCAGAGACAATTCCAAGAACACCCTGTATCTGCAAATGA

ACAGCCTGAGAGCCGAGGACACGGCCGTATATTACTGTGCAAGACATGGA

GACTATGACGACGACGACGCGATGGACTACTGGGGCCAAGGAACCCTGGT

CACCGTCTCCTCAGCCTCCACCAAAGGCCCCAGCGTCTTCCCCCTCGCGC

CGTCCTCCAAGTCCACCTCGGGTGGCACCGCCGCCCTGGGCTGCCTGGTC

AAGGACTACTTCCCGGAGCCTGTGACCGTGTCCTGGAACTCGGGCGCGCT

CACGAGCGGCGTACACACCTTCCCGGCGGTGCTCCAGTCCTCCGGGCTGT

ACTCGCTCTCGTCGGTCGTCACGGTGCCGTCCTCCTCCCTGGGCACCCAG

ACCTACATCTGCAACGTGAACCACAAGCCGTCCAACACCAAGGTGGATAA

GAAGGTCGAGCCCAAGTCGTGCGACAAGACGCACACGTGCCCGCCGTGCC

```
CGGCCCCGGAGCTGCTGGGCGGCCCCTCGGTCTTCCTGTTCCCCCCGAAG

CCCAAGGATACGCTGATGATCTCCCGCACCCCGGAGGTCACCTGCGTGGT

GGTGGACGTCTCCCACGAGGACCCGGAGGTGAAATTCAACTGGTACGTCG

ACGGAGTGGAGGTCCACAACGCCAAGACCAAGCCCCGGGAGGAGCAGTAC

AACTCCACGTACCGCGTCGTCTCCGTCCTGACCGTCCTCCACCAGGACTG

GCTGAACGGCAAGGAGTACAAGTGTAAGGTCTCCAACAAGGCGCTGCCCG

CCCCCATCGAGAAGACCATCTCCAAGGCAAAGGGTCAGCCGCGGGAGCCG

CAGGTCTATACCCTCCCCCCGTCCCGCGACGAGCTGACGAAAAACCAGGT

CTCCCTGACCTGCCTGGTGAAGGGTTTCTACCCCTCCGACATCGCGGTCG

AGTGGGAGTCGAACGGCCAGCCGGAGAACAACTACAAGACCACCCCCCCC

GTGCTCGACAGTGACGGCTCGTTCTTCCTGTACTCGAAGCTGACCGTCGA

CAAGTCGCGCTGGCAGCAGGGCAACGTCTTCTCGTGCTCCGTTATGCACG

AGGCCCTGCACAACCACTACACGCAGAAGAGTCTTTCGCTGTCCCCGGGG

AAGTGA.
```

The heavy chain Ab7-V$_{H5}$-IgG1 has the following sequence (FR1-CDR1-FR2-CDR2-FR3-CDR3-FR4-Constant region):

(SEQ ID NO: 39)
EVQLVESGGGLVQPGGSLRLSCAASGFTFTSYSMSWVRQAPGKGLEWVSY
ISYDGGSAYYPDTVKGRFTISRDNSKNTLYLQMNSLRAEDTAVYYCARHG
DYDDDDAMDYWGQGTLVTVSSASTKGPSVFPLAPSSKSTSGGTAALGCLV
KDYFPEPVTVSWNSGALTSGVHTFPAVLQSSGLYSLSSVVTVPSSSLGTQ
TYICNVNHKPSNTKVDKKVEPKSCDKTHTCPPCPAPELLGGPSVFLFPPK
PKDTLMISRTPEVTCVVVDVSHEDPEVKFNWYVDGVEVHNAKTKPREEQY
NSTYRVVSVLTVLHQDWLNGKEYKCKVSNKALPAPIEKTISKAKGQPREP
QVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPG
K.

A nucleic acid sequence encoding the heavy chain Ab7-V$_{H5}$-IgG1 has the following sequence (FR1-CDR1-FR2-CDR2-FR3-CDR3-FR4-Constant region):

```
                                         (SEQ ID NO: 40)
GAGGTGCAGCTGGTGGAGTCTGGGGGAGGCTTGGTACAGCCTGGGGGGTC

CCTGAGACTCTCCTGTGCAGCCTCTGGATTCACCTTTACCAGCTATTCCA

TGAGCTGGGTCCGCCAGGCTCCAGGGAAGGGGCTGGAGTGGGTGTCTTAC

ATTAGTTATGATGGTGGTAGCGCCTACTATCCTGACACTGTGAAGGGCCG

GTTCACCATCTCCAGAGACAATTCCAAGAACACCCTGTATCTGCAAATGA

ACAGCCTGAGAGCCGAGGACACGGCCGTATATTACTGTGCAAGACATGGA

GACTATGACGACGACGACGCGATGGACTACTGGGGCCAAGGAACCCTGGT

CACCGTCTCCTCAGCCTCCACCAAGGGCCCCAGCGTCTTCCCCCTCGCGC

CGTCCTCCAAGTCCACCTCGGGTGGCACCGCCGCCCTGGGCTGCCTGGTC

AAGGACTACTTCCCGGAGCCTGTGACCGTGTCCTGGAACTCGGGCGCGCT
```

```
CACGAGCGGCGTACACACCTTCCCGGCGGTGCTCCAGTCCTCCGGGCTGT

ACTCGCTCTCGTCGGTCGTCACGGTGCCGTCCTCCTCCCTGGGCACCCAG

ACCTACATCTGCAACGTGAACCACAAGCCGTCCAACACCAAGGTGGATAA

GAAGGTCGAGCCCAAGTCGTGCGACAAGACGCACACGTGCCCGCCGTGCC

CGGCCCCGGAGCTGCTGGGCGGCCCCTCGGTCTTCCTGTTCCCCCCGAAG

CCCAAGGATACGCTGATGATCTCCCGCACCCCGGAGGTCACCTGCGTGGT

GGTGGACGTCTCCCACGAGGACCCGGAGGTGAAATTCAACTGGTACGTCG

ACGGAGTGGAGGTCCACAACGCCAAGACCAAGCCCCGGGAGGAGCAGTAC

AACTCCACGTACCGCGTCGTCTCCGTCCTGACCGTCCTCCACCAGGACTG

GCTGAACGGCAAGGAGTACAAGTGTAAGGTCTCCAACAAGGCGCTGCCCG

CCCCCATCGAGAAGACCATCTCCAAGGCAAAGGGTCAGCCGCGGGAGCCG

CAGGTCTATACCCTCCCCCCGTCCCGCGACGAGCTGACGAAAAACCAGGT

CTCCCTGACCTGCCTGGTGAAGGGTTTCTACCCCTCCGACATCGCGGTCG

AGTGGGAGTCGAACGGCCAGCCGGAGAACAACTACAAGACCACCCCCCCC

GTGCTCGACAGTGACGGCTCGTTCTTCCTGTACTCGAAGCTGACCGTCGA

CAAGTCGCGCTGGCAGCAGGGCAACGTCTTCTCGTGCTCCGTTATGCACG

AGGCCCTGCACAACCACTACACGCAGAAGAGTCTTTCGCTGTCCCCGGGG

AAGTGA.
```

The light chain Ab7-V$_{L0}$-Kappa has the following sequence (FR1-CDR1-FR2-CDR2-FR3-CDR3-FR4-Constant region):

(SEQ ID NO: 41)
DIQMTQSPASLSASVGETVTITCRASENIYSYLAWYQQKQGKSPQLLVYN
AETLTEGVPSRFSGSGSGTQFSLKINSLQPEDFGNYYCQHHYGTPLT**FGA
GTKLDLK**RTVAAPSVFIFPPSDEQLKSGTASVVCLLNNFYPREAKVQWKV
DNALQSGNSQESVTEQDSKDSTYSLSSTLTLSKADYEKHKVYACEVTHQG
LSSPVTKSFNRGEC.

A nucleic acid sequence encoding the light chain Ab7-V$_{L0}$-Kappa has the following sequence (FR1-CDR1-FR2-CDR2-FR3-CDR3-FR4-Constant region):

```
                                         (SEQ ID NO: 42)
GACATCCAGATGACCCAGTCTCCAGCCTCCCTGTCTGCATCTGTAGGAGA

AACTGTCACCATCACTTGCCGGGCAAGTGAGAACATTTACAGCTATTTAG

CATGGTATCAGCAGAAACAGGGGAAATCTCCTCAGCTCCTGGTCTATAAT

GCAGAAACCTTGACAGAAGGGGTCCCATCAAGGTTCAGCGGCAGTGGATC

TGGGACACAATTCTCTCTCAAGATCAACAGTCTGCAACCTGAAGATTTTG

GGAATTACTACTGTCAACATCATTACGGTACCCCGCTCACATTCGGCGCT

GGGACCAAGCTGGATCTGAAACGAACGGTGGCCGCGCCGAGCGTCTTCAT

CTTCCCGCCTTCCGACGAGCAGCTCAAGTCCGGGACCGCCTCCGTAGTAT

GCCTCCTCAATAACTTCTACCCCCGGGAGGCGAAGGTCCAGTGGAAGGTC

GACAACGCCCTCCAATCGGGCAACTCCCAGGAGTCGGTGACCGAGCAGGA
```

The light chain Ab7-Vu-Kappa has the following sequence (FR1-CDR1-FR2-CDR2-FR3-CDR3-FR4-Constant region):

(SEQ ID NO: 43)
DIQMTQSPSSLSASVGDRVTITCRASENIYSYLAWYQQKQGKAPKLLVYN

AETLTEGVPSRFSGSGSGTDFTLTISSLQPEDFANYYCQHHYGTPLTFGQ

GTKLDIKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC.

A nucleic acid sequence encoding the light chain Ab7-Vu-Kappa has the following sequence (FR1-CDR1-FR2-CDR2-FR3-CDR3-FR4-Constant region):

(SEQ ID NO: 44)
GACATCCAGATGACCCAGTCTCCATCCTCCCTGTCTGCATCTGTAGGAGA

CAGAGTCACCATCACTTGCCGGGCAAGTGAGAACATTTACAGCTATTTAG

CATGGTATCAGCAGAAACAGGGGAAAGCCCCTAAGCTCCTGGTCTATAAT

GCAGAAACCTTGACAGAAGGGGTCCCATCAAGGTTCAGCGGCAGTGGATC

TGGGACAGATTTCACTCTCACCATCAGCAGTCTGCAACCTGAAGATTTTG

CAAATTACTACTGTCAACATCATTACGGTACCCCGCTCACATTCGGCCAA

GGGACCAAGCTGGATATCAAACGAACGGTGGCCGCGCCGAGCGTCTTCAT

CTTCCCGCCTTCCGACGAGCAGCTCAAGTCCGGGACCGCCTCCGTAGTAT

GCCTCCTCAATAACTTCTACCCCGGGAGGCGAAGGTCCAGTGGAAGGTC

GACAACGCCCTCCAATCGGGCAACTCCCAGGAGTCGGTGACCGAGCAGGA

TTCCAAGGACTCGACCTACAGTCTAAGCTCCACCCTCACACTGTCGAAGG

CGGACTACGAGAAGCACAAGGTGTACGCCTGCGAGGTCACCCACCAGGGC

CTGAGCAGCCCGGTCACCAAGTCCTTCAACCGGGGCGAGTGCTGA.

The light chain Ab7-$V_{L2}$-Kappa has the following sequence (FR1-CDR1-FR2-CDR2-FR3-CDR3-FR4-Constant region):

(SEQ ID NO: 45)
DIQMTQSPSSLSASVGDRVTITCRASENIYSYLAWYQQKPGKAPKLLVYN

AETLTEGVPSRFSGSGSGTDFTLTISSLQPEDFANYYCQHHYGTPLTFGQ

GTKLEIKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC.

A nucleic acid sequence encoding the light chain Ab7-$V_{L2}$-Kappa has the following sequence (FR1-CDR1-FR2-CDR2-FR3-CDR3-FR4-Constant region):

(SEQ ID NO: 46)
GACATCCAGATGACCCAGTCTCCATCCTCCCTGTCTGCATCTGTAGGAGA

CAGAGTCACCATCACTTGCCGGGCAAGTGAGAACATTTACAGCTATTTAG

CATGGTATCAGCAGAAACAGGGGAAAGCCCCTAAGCTCCTGGTCTATAAT

GCAGAAACCTTGACAGAAGGGGTCCCATCAAGGTTCAGCGGCAGTGGATC

TGGGACAGATTTCACTCTCACCATCAGCAGTCTGCAACCTGAAGATTTTG

CAAATTACTACTGTCAACATCATTACGGTACCCCGCTCACATTCGGCCAA

GGGACCAAGCTGGAAATCAAACGAACGGTGGCCGCGCCGAGCGTCTTCAT

CTTCCCGCCTTCCGACGAGCAGCTCAAGTCCGGGACCGCCTCCGTAGTAT

GCCTCCTCAATAACTTCTACCCCGGGAGGCGAAGGTCCAGTGGAAGGTC

GACAACGCCCTCCAATCGGGCAACTCCCAGGAGTCGGTGACCGAGCAGGA

TTCCAAGGACTCGACCTACAGTCTAAGCTCCACCCTCACACTGTCGAAGG

CGGACTACGAGAAGCACAAGGTGTACGCCTGCGAGGTCACCCACCAGGGC

CTGAGCAGCCCGGTCACCAAGTCCTTCAACCGGGGCGAGTGCTGA.

The light chain Ab7-$V_{L3}$-Kappa has the following sequence (FR1-CDR1-FR2-CDR2-FR3-CDR3-FR4-Constant region):

(SEQ ID NO: 47)
DIQMTQSPSSLSASVGDRVTITCRASENIYSYLAWYQQKPGKAPKLLVYN

AETLTEGVPSRFSGSGSGTDFTLTISSLQPEDFATYYCQHHYGTPLTFGQ

GTKLEIKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC.

A nucleic acid sequence encoding the light chain Ab7-$V_{L3}$-Kappa has the following sequence (FR1-CDR1-FR2-CDR2-FR3-CDR3-FR4-Constant region):

(SEQ ID NO: 48)
GACATCCAGATGACCCAGTCTCCATCCTCCCTGTCTGCATCTGTAGGAGA

CAGAGTCACCATCACTTGCCGGGCAAGTGAGAACATTTACAGCTATTTAG

CATGGTATCAGCAGAAACAGGGGAAAGCCCCTAAGCTCCTGGTCTATAAT

GCAGAAACCTTGACAGAAGGGGTCCCATCAAGGTTCAGCGGCAGTGGATC

TGGGACAGATTTCACTCTCACCATCAGCAGTCTGCAACCTGAAGATTTTG

CAACTTACTACTGTCAACATCATTACGGTACCCCGCTCACATTCGGCCAA

GGGACCAAGCTGGAAATCAAACGAACGGTGGCCGCGCCGAGCGTCTTCAT

CTTCCCGCCTTCCGACGAGCAGCTCAAGTCCGGGACCGCCTCCGTAGTAT

GCCTCCTCAATAACTTCTACCCCGGGAGGCGAAGGTCCAGTGGAAGGTC

GACAACGCCCTCCAATCGGGCAACTCCCAGGAGTCGGTGACCGAGCAGGA

TTCCAAGGACTCGACCTACAGTCTAAGCTCCACCCTCACACTGTCGAAGG

CGGACTACGAGAAGCACAAGGTGTACGCCTGCGAGGTCACCCACCAGGGC

CTGAGCAGCCCGGTCACCAAGTCCTTCAACCGGGGCGAGTGCTGA.

The light chain Ab7-V$_{L4}$-Kappa has the following sequence (FR1-CDR1-FR2-CDR2-FR3-CDR3-FR4-Constant region):

(SEQ ID NO: 49)
DIQMTQSPSSLSASVGDRVTITCRASENIYSYLNWYQQKPGKAPKLLVYN

AETLTEGVPSRFSGSGSGTDFTLTISSLQPEDFATYYCQHHYGTPLTFGQ

GTKLEIKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC.

A nucleic acid sequence encoding the light chain Ab7-V$_{L4}$-Kappa has the following sequence (FR1-CDR1-FR2-CDR2-FR3-CDR3-FR4-Constant region):

(SEQ ID NO: 50)
GACATCCAGATGACCCAGTCTCCATCCTCCCTGTCTGCATCTGTAGGAGA

CAGAGTCACCATCACTTGCCGGGCAAGTGAGAACATTTACAGCTATTTAA

ATTGGTATCAGCAGAAACCAGGGAAAGCCCCTAAGCTCCTGGTCTATAAT

GCAGAAACCTTGACAGAAGGGGTCCCATCAAGGTTCAGCGGCAGTGGATC

TGGGACAGATTTCACTCTCACCATCAGCAGTCTGCAACCTGAAGATTTTG

CAACTTACTACTGTCAACATCATTACGGTACCCCGCTCACATTCGGCCAA

GGGACCAAGCTGGAAATCAAACGAACGGTGGCCGCGCCGAGCGTCTTCAT

CTTCCCGCCTTCCGACGAGCAGCTCAAGTCCGGGACCGCCTCCGTAGTAT

GCCTCCTCAATAACTTCTACCCCCGGGAGGCGAAGGTCCAGTGGAAGGTC

GACAACGCCCTCCAATCGGGCAACTCCCAGGAGTCGGTGACCGAGCAGGA

TTCCAAGGACTCGACCTACAGTCTAAGCTCCACCCTCACACTGTCGAAGG

CGGACTACGAGAAGCACAAGGTGTACGCCTGCGAGGTCACCCACCAGGGC

CTGAGCAGCCCGGTCACCAAGTCCTTCAACCGGGGCGAGTGCTGA.

It is also contemplated that the variable region sequences can be fused to other antibody constant region sequences to produce full length immunoglobulin heavy and light chains. For example, the Ab7-V$_{H0}$, Ab7-V$_{H1}$, Ab7-V$_{H2}$, Ab7-V$_{H3}$, Ab7-V$_{H4}$, or Ab7-V$_{H5}$ heavy chain variable regions may be combined with a human IgG2, IgG3, IgG4, or an IgG4 comprising one or more amino acid substitutions in the constant region (e.g., IgG4mt, or IgG4mt2). Similarly, the Ab7-V$_L$0, Ab7-V$_L$1, Ab7-V$_L$2, Ab7-V$_L$3 or Ab7-V$_L$4 light chain variable regions may be combined with a human lambda constant region.

DNA fragments encoding the heavy and light chain variable regions of Ab7 and the humanized Ab7 variants described above were synthesized with flanking restriction enzyme sites for cloning into a pANT expression vector (Antitope) system for IgG1 heavy and kappa light chains. All constructs were confirmed by sequencing. Heavy and light chain combinations shown in Table 2 were transiently transfected into HEK293 EBNA adherent cells (LGC Standards, Teddington, UK) using a PEI transfection method and incubated for seven days post-transfection.

TABLE 2

| Antibody | Heavy Chain | Light Chain |
|---|---|---|
| Ab7.1 | Ab7-V$_{H0}$-IgG1 (SEQ ID NO: 29) | Ab7-V$_{L0}$-Kappa (SEQ ID NO: 41) |
| Ab7.2 | Ab7-V$_{H0}$-IgG1 (SEQ ID NO: 29) | Ab7-V$_{L1}$-Kappa (SEQ ID NO: 43) |
| Ab7.3 | Ab7-V$_{H1}$-IgG1 (SEQ ID NO: 31) | Ab7-V$_{L0}$-Kappa (SEQ ID NO: 41) |
| Ab7.4 | Ab7-V$_{H1}$-IgG1 (SEQ ID NO: 31) | Ab7-V$_{L1}$-Kappa (SEQ ID NO: 43) |
| Ab7.5 | Ab7-V$_{H1}$-IgG1 (SEQ ID NO: 31) | Ab7-V$_{L2}$-Kappa (SEQ ID NO: 45) |
| Ab7.6 | Ab7-V$_{H1}$-IgG1 (SEQ ID NO: 31) | Ab7-V$_{L3}$-Kappa (SEQ ID NO: 47) |
| Ab7.7 | Ab7-V$_{H1}$-IgG1 (SEQ ID NO: 31) | Ab7-V$_{L4}$-Kappa (SEQ ID NO: 49) |
| Ab7.8 | Ab7-V$_{H2}$-IgG1 (SEQ ID NO: 33) | Ab7-V$_{L1}$-Kappa (SEQ ID NO: 43) |
| Ab7.9 | Ab7-V$_{H2}$-IgG1 (SEQ ID NO: 33) | Ab7-V$_{L2}$-Kappa (SEQ ID NO: 45) |
| Ab7.10 | Ab7-V$_{H2}$-IgG1 (SEQ ID NO: 33) | Ab7-V$_{L3}$-Kappa (SEQ ID NO: 47) |
| Ab7.11 | Ab7-V$_{H2}$-IgG1 (SEQ ID NO: 33) | Ab7-V$_{L4}$-Kappa (SEQ ID NO: 49) |
| Ab7.12 | Ab7-V$_{H3}$-IgG1 (SEQ ID NO: 35) | Ab7-V$_{L1}$-Kappa (SEQ ID NO: 43) |
| Ab7.13 | Ab7-V$_{H3}$-IgG1 (SEQ ID NO: 35) | Ab7-V$_{L2}$-Kappa (SEQ ID NO: 45) |
| Ab7.14 | Ab7-V$_{H3}$-IgG1 (SEQ ID NO: 35) | Ab7-V$_{L3}$-Kappa (SEQ ID NO: 47) |
| Ab7.15 | Ab7-V$_{H3}$-IgG1 (SEQ ID NO: 35) | Ab7-V$_{L4}$-Kappa (SEQ ID NO: 49) |
| Ab7.16 | Ab7-V$_{H4}$-IgG1 (SEQ ID NO: 37) | Ab7-V$_{L1}$-Kappa (SEQ ID NO: 43) |
| Ab7.17 | Ab7-V$_{H4}$-IgG1 (SEQ ID NO: 37) | Ab7-V$_{L2}$-Kappa (SEQ ID NO: 45) |
| Ab7.18 | Ab7-V$_{H4}$-IgG1 (SEQ ID NO: 37) | Ab7-V$_{L3}$-Kappa (SEQ ID NO: 47) |
| Ab7.19 | Ab7-V$_{H4}$-IgG1 (SEQ ID NO: 37) | Ab7-V$_{L4}$-Kappa (SEQ ID NO: 49) |
| Ab7.20 | Ab7-V$_{H5}$-IgG1 (SEQ ID NO: 39) | Ab7-V$_{L1}$-Kappa (SEQ ID NO: 43) |
| Ab7.21 | Ab7-V$_{H5}$-IgG1 (SEQ ID NO: 39) | Ab7-V$_{L2}$-Kappa (SEQ ID NO: 45) |
| Ab7.22 | Ab7-V$_{H5}$-IgG1 (SEQ ID NO: 39) | Ab7-V$_{L3}$-Kappa (SEQ ID NO: 47) |
| Ab7.23 | Ab7-V$_{H5}$-IgG1 (SEQ ID NO: 39) | Ab7-V$_{L4}$-Kappa (SEQ ID NO: 49) |

Antibodies were purified from cell culture supernatants on Protein A-conjugated sepharose columns (GE Healthcare, Little Chalfont, UK), buffer exchanged into 1×DPBS pH 7.2 and quantified by OD$_{280nm}$ using an extinction coefficient (Ec$_{(0.1\%)}$) based on the predicted amino acid sequence. 1 µg of each antibody was analyzed by SDS-PAGE and bands corresponding to the profile of a typical antibody were observed (data not shown).

In Vitro Characterization of Anti-EBI3 Antibodies

The Ab7 antibody and Ab7 antibody variants produced as described in Table 2 were tested in a series of in vitro assays to ascertain their biological characteristics and activities.

In order to assess the binding of the humanized Ab7 antibody variants relative to the chimeric Ab7.1 antibody, a binding competition ELISA was established. Assay plates were coated with 1 µg/mL of human IL-27 (hIL-27) (R&D Systems, Abingdon, UK) diluted in 1×DPBS pH 7.2 and incubated overnight at 4° C. All antibodies were diluted in 2% BSA/DPBS to 25 µg/mL and serially diluted three-fold down the plate to generate an eight point binding curve. Antibody dilutions were pre-mixed with biotinylated Ab7.1 antibody at a constant final concentration of 0.08 µg/mL. The antibody mixtures were then transferred onto the coated assay plates and incubated for 1 hour at room temperature. The binding of biotinylated Ab7.1 antibody was detected with streptavidin-peroxidase conjugate (Sigma-Aldrich, Gillingham, UK) and TMB substrate (ThermoFisher, Loughborough, UK). The reaction was stopped with 1M HCl and absorbance read at 450 nm on a Dynex Technologies MRX TC II plate reader.

Absolute $IC_{50}$ values of the tested antibodies were determined using a four-parameter logistic curve. $IC_{50}$ normalized relative to the $IC_{50}$ of the chimeric antibody on each plate are summarized in Table 3. The results show that all humanized Ab7 variants generated, with the exception of variants containing the Ab7-$V_{L4}$ light chain, have similar binding profiles to the chimeric Ab7.1 antibody, with most variants competing within two-fold of the chimeric Ab7.1 antibody.

TABLE 3

| Antibody | Average Relative $IC_{50}$ to Ab7.1 | Standard Deviation | No. of Repeats |
|---|---|---|---|
| Ab7.1 | 1 | | |
| Ab7.2 | 0.76 | 0 | 2 |
| Ab7.3 | 0.76 | 0.27 | 2 |
| Ab7.4 | 0.97 | 0.46 | 2 |
| Ab7.4 | 0.73 | 0.25 | 2 |
| Ab7.5 | 1.39 | 0.13 | 2 |
| Ab7.6 | ND | — | 1 |
| Ab7.8 | 1.43 | 0.05 | 2 |
| Ab7.9 | 1.85 | 0.21 | 2 |
| Ab7.10 | 1.85 | 0.22 | 2 |
| Ab7.11 | ND | — | 1 |
| Ab7.12 | 1.33 | 0.21 | 2 |
| Ab7.13 | 1.37 | 0.08 | 2 |
| Ab7.14 | 1.48 | 0.07 | 2 |
| Ab7.15 | ND | — | 1 |
| Ab7.16 | 1.81 | 0.35 | 2 |
| Ab7.17 | 1.55 | 0.44 | 2 |
| Ab7.18 | 1.39 | 0.37 | 2 |
| Ab7.19 | ND | — | 1 |
| Ab7.20 | 1.6 | 0.06 | 2 |
| Ab7.21 | 2.16 | 0.33 | 2 |
| Ab7.22 | 2.50 | 0.95 | 2 |
| Ab7.23 | ND | — | 1 |

The antibodies were further characterized by surface plasmon resonance (SPR). Kinetic experiments were performed on a Biacore T200 (GE Healthcare, Uppsala, Sweden). All experiments were run at 25° C. with HBS-P+ running buffer (pH 7.4) (GE Healthcare, Little Chalfont, UK) using hIL-27 (R&D Systems, Abingdon, UK). Human IL-27 (hIL-27) antigen was captured on a CM5 chip to ~16 RU. Immobilization was carried out at a protein concentration of 1 µg/mL in 10 mM acetate buffer pH 5.0. A three point, three-fold dilution range from 3.3 nM to 30 nM of antibody diluted in HBS-P+ buffer without regeneration between each concentration was used. The association phase for the three injections of increasing concentrations of antibody was monitored for 75 seconds each time and a single dissociation phase was measured for 250 seconds following the last injection of antibody. Regeneration of the hIL-27 surface was conducted using a single injection of 2M $MgCl_2$ for 120 s. Multiple repeats (n=4) of the chimeric antibody were performed throughout the assay to check the stability of the surface and analyte over the kinetic cycles.

Both 1:1 binding and bivalent analyte models were used to analyze the data due to the bivalent nature of the antibody. The results from the 1:1 binding model analysis are summarized in Table 4 and results from the bivalent analyte model are summarized in Table 5.

TABLE 4

| Antibody | ka (1/Ms) | kd (1/s) | KD (M) | Chi$^2$ (RU$^2$) | Relative KD to Ab7.1 |
|---|---|---|---|---|---|
| Ab7.1 | $1.4 \times 10^6$ | $1.5 \times 10^{-3}$ | $1.0 \times 10^{-9}$ | 0.282 | 1.0 |
| Ab7.2 | $1.5 \times 10^6$ | $1.8 \times 10^{-3}$ | $1.2 \times 10^{-9}$ | 0.237 | 1.2 |
| Ab7.3 | $1.5 \times 10^6$ | $1.5 \times 10^{-3}$ | $9.6 \times 10^{-10}$ | 0.321 | 0.9 |
| Ab7.4 | $1.5 \times 10^6$ | $1.8 \times 10^{-3}$ | $1.2 \times 10^{-9}$ | 0.235 | 1.2 |
| Ab7.4 | $1.5 \times 10^6$ | $1.8 \times 10^{-3}$ | $1.3 \times 10^{-9}$ | 0.212 | 1.2 |
| Ab7.5 | $1.5 \times 10^6$ | $1.8 \times 10^{-3}$ | $1.2 \times 10^{-9}$ | 0.222 | 1.2 |
| Ab7.6 | — | — | — | — | — |
| Ab7.8 | $1.3 \times 10^6$ | $1.8 \times 10^{-3}$ | $1.5 \times 10^{-9}$ | 0.0932 | 1.4 |
| Ab7.9 | $1.3 \times 10^6$ | $1.9 \times 10^{-3}$ | $1.5 \times 10^{-9}$ | 0.0953 | 1.5 |
| Ab7.10 | $1.3 \times 10^6$ | $1.8 \times 10^{-3}$ | $1.4 \times 10^{-9}$ | 0.105 | 1.4 |
| Ab7.11 | — | — | — | — | — |
| Ab7.12 | $1.5 \times 10^6$ | $1.8 \times 10^{-3}$ | $1.2 \times 10^{-9}$ | 0.265 | 1.2 |
| Ab7.13 | $1.5 \times 10^6$ | $1.8 \times 10^{-3}$ | $1.2 \times 10^{-9}$ | 0.235 | 1.2 |
| Ab7.14 | $1.5 \times 10^6$ | $1.8 \times 10^{-3}$ | $1.2 \times 10^{-9}$ | 0.232 | 1.2 |
| Ab7.15 | — | — | — | — | — |
| Ab7.16 | $1.3 \times 10^6$ | $1.8 \times 10^{-3}$ | $1.5 \times 10^{-9}$ | 0.092 | 1.4 |
| Ab7.17 | $1.3 \times 10^6$ | $1.9 \times 10^{-3}$ | $1.5 \times 10^{-9}$ | 0.101 | 1.5 |
| Ab7.18 | $1.3 \times 10^6$ | $1.9 \times 10^{-3}$ | $1.5 \times 10^{-9}$ | 0.0969 | 1.4 |
| Ab7.19 | — | — | — | — | — |
| Ab7.20 | $1.3 \times 10^6$ | $1.8 \times 10^{-3}$ | $1.4 \times 10^{-9}$ | 0.109 | 1.4 |
| Ab7.21 | $1.2 \times 10^6$ | $1.9 \times 10^{-3}$ | $1.5 \times 10^{-9}$ | 0.0793 | 1.5 |
| Ab7.22 | $1.3 \times 10^6$ | $1.9 \times 10^{-3}$ | $1.5 \times 10^{-9}$ | 0.081 | 1.5 |
| Ab7.23 | — | — | — | — | — |

TABLE 5

| Analyte | ka1 (1/Ms) | ka2 (1/RUs) | kd1 (1/s) | kd2 (1/s) | Chi$^2$ (RU$^2$) |
|---|---|---|---|---|---|
| Ab7.1 | $6.7 \times 10^5$ | $2.1 \times 10^{-2}$ | $2.2 \times 10^{-3}$ | $4.6 \times 10^{-2}$ | 0.138 |
| Ab7.2 | $7.0 \times 10^5$ | $3.5 \times 10^{-2}$ | $2.7 \times 10^{-3}$ | $8.7 \times 10^{-2}$ | 0.108 |
| Ab7.3 | $7.5 \times 10^5$ | $2.9 \times 10^{-2}$ | $2.2 \times 10^{-3}$ | $6.3 \times 10^{-2}$ | 0.132 |
| Ab7.4 | $7.2 \times 10^5$ | $7.2 \times 10^{-2}$ | $2.6 \times 10^{-3}$ | $1.9 \times 10^{-1}$ | 0.106 |
| Ab7.4 | $7.1 \times 10^5$ | $1.7 \times 10^{-2}$ | $2.5 \times 10^{-3}$ | $4.9 \times 10^{-2}$ | 0.103 |
| Ab7.5 | $6.8 \times 10^5$ | $2.8 \times 10^{-2}$ | $2.7 \times 10^{-3}$ | $6.8 \times 10^{-2}$ | 0.104 |
| Ab7.6 | — | — | — | — | — |
| Ab7.8 | $5.8 \times 10^5$ | $6.4 \times 10^{-2}$ | $2.7 \times 10^{-3}$ | $1.5 \times 10^{-1}$ | 0.0514 |
| Ab7.9 | $5.9 \times 10^5$ | $4.3 \times 10^{-2}$ | $2.8 \times 10^{-3}$ | $1.1 \times 10^{-1}$ | 0.0526 |
| Ab7.10 | $6.0 \times 10^5$ | $8.4 \times 10^{-2}$ | $2.5 \times 10^{-3}$ | $2.0 \times 10^{-1}$ | 0.0573 |
| Ab7.11 | — | — | — | — | — |
| Ab7.12 | $7.5 \times 10^5$ | $1.1 \times 10^{-1}$ | $2.6 \times 10^{-3}$ | $2.9 \times 10^{-1}$ | 0.119 |
| Ab7.13 | $7.4 \times 10^5$ | $2.0 \times 10^{-2}$ | $2.6 \times 10^{-3}$ | $5.3 \times 10^{-2}$ | 0.109 |
| Ab7.14 | $7.0 \times 10^5$ | $3.9 \times 10^{-2}$ | $2.6 \times 10^{-3}$ | $9.9 \times 10^{-2}$ | 0.106 |
| Ab7.15 | — | — | — | — | — |
| Ab7.16 | $5.7 \times 10^5$ | $4.0 \times 10^{-2}$ | $2.7 \times 10^{-3}$ | $9.1 \times 10^{-2}$ | 0.0512 |
| Ab7.17 | $5.8 \times 10^5$ | $3.9 \times 10^{-2}$ | $2.9 \times 10^{-3}$ | $9.0 \times 10^{-2}$ | 0.0569 |
| Ab7.18 | $5.7 \times 10^5$ | $5.3 \times 10^{-2}$ | $2.8 \times 10^{-3}$ | $1.1 \times 10^{-1}$ | 0.054 |
| Ab7.19 | — | — | — | — | — |
| Ab7.20 | $6.2 \times 10^5$ | $3.6 \times 10^{-2}$ | $2.5 \times 10^{-3}$ | $8.6 \times 10^{-2}$ | 0.0604 |
| Ab7.21 | $5.5 \times 10^5$ | $4.3 \times 10^{-2}$ | $2.7 \times 10^{-3}$ | $9.7 \times 10^{-2}$ | 0.0459 |
| Ab7.22 | $5.8 \times 10^5$ | $4.9 \times 10^{-1}$ | $2.7 \times 10^{-3}$ | 1.11 | 0.0432 |
| Ab7.23 | — | — | — | — | — |

Single cycle kinetics using the 1:1 model (Table 4) demonstrated that Ab7-$V_{L4}$ humanized variants did not bind to hIL-27 and the remaining variants bound within two-fold of the chimeric antibody, consistent with results from the bivalent analyte model (Table 5) and the competition ELISA.

In summary, the binding affinity of the Ab7.1 chimeric antibody as determined by single cycle kinetics and using a 1:1 binding model was 1 nM. All of the humanized variants had a KD of 1.5 nM or lower, with the exception of the Ab7-$V_{L4}$ containing variants in which binding was abolished. These results demonstrate that the Ab7 antibody and the Ab7 antibody variants bind with high affinity to the EBI3 subunit of IL-27.

Example 2: Generation of Anti-IL-27 Antibodies in Yeast that Specifically Bind EBI3 and/or P28 Subunits of Human IL-27

Additional anti-IL-27 monoclonal antibodies representing multiple epitope bins were selected from eight naïve human synthetic yeast libraries using methods described below.

Materials and Methods

Eight naïve human synthetic yeast libraries each of ~$10^9$ diversity was propagated as previously described (see e.g., Xu et al., (2013) Protein Eng Des Sel 26(10):663-670; WO2009036379; WO2010105256; and WO2012009568, all of which are incorporated herein by reference in their entireties). For the first two rounds of selection, a magnetic bead sorting technique utilizing the Miltenyi MACS system was performed, as previously described (see e.g., Siegel et al. (2004) J Immunol Methods 286(1-2)141-153, which is incorporated herein by reference in its entirety).

Briefly, yeast cells (~$10^{10}$ cells/library) were incubated with 3 ml of 100 nM biotinylated antigen (recombinant human R&D Systems) for 30 min at 30° C. in wash buffer (phosphate-buffered saline (PBS)/0.1% bovine serum albumin (BSA)). After washing once with 40 ml ice-cold wash buffer, the cell pellet was resuspended in 20 mL wash buffer, and Streptavidin MicroBeads (500 µl) were added to the yeast and incubated for 15 min at 4° C. Next, the yeast cells were pelleted, resuspended in 20 ml. wash buffer, and loaded onto a Miltenyi LS column. After the 20 mL was loaded, the column was washed 3 times with 3 ml wash buffer. The column was then removed from the magnetic field, and the yeast cells were eluted with 5 mL of growth media and then grown overnight. The following rounds of selection were performed using flow cytometry. Approximately $2\times10^7$ yeast cells were pelleted, washed three times with wash buffer, and incubated at 30° C. with either decreasing concentrations of biotinylated antigen (100 to 1 nM) under equilibrium conditions, 30 nM biotinylated antigens of different species in order to obtain species cross-reactivity, or with a poly-specificity depletion reagent (PSR) to remove non-specific antibodies from the selection. For the PSR depletion, the libraries were incubated with a 1:10 dilution of biotinylated PSR reagent.

Yeast cells were then washed twice with wash buffer and stained with LC-FITC (diluted 1:100) and either SA-633 (diluted 1:500) or EAPE (diluted 1:50) secondary reagents for 15 min at 4° C. After washing twice with wash buffer, the cell pellets were resuspended in 0.3 mL wash buffer and transferred to strainer-capped sort tubes. Sorting was performed using a FACS ARIA sorter (BD Biosciences) and sort gates were determined to select for antibodies with desired characteristics. Selection rounds were repeated until a population with all of the desired characteristics was obtained. After the final round of sorting, yeast cells were plated and individual colonies were picked for characterization.

Light Chain Diversification

Light chain diversification protocol was used during the primary discovery phase for further discovery and improvement of antibodies.

Light chain batch diversification protocol: Heavy chain plasmids from a naïve selection output were extracted from the yeast via smash and grab, propagated in and subsequently purified from *E. coli* and transformed into a light chain library with a diversity of $5\times10^6$. Selections were performed with one round of MACS and four rounds of FACS employing the same conditions as the naïve discovery.

Antibody Optimization

Optimization of antibodies was performed by introducing diversities into the heavy chain and light chain variable regions as described below.

CDRH1 and CDRH2 selection: The CDRH3 of a single antibody was recombined into a premade library with CDRH1 and CDRH2 variants of a diversity of $1\times10^8$ and selections were performed with one round of MACS and four rounds of FACS as described in the naïve discovery. In the different. FACS rounds the libraries were looked at for PSR binding, species cross-reactivity, and affinity pressure by titration or parental Fab pre-complexing, and sorting was performed in order to obtain a population with the desired characteristics.

Antibody Production and Purification

Yeast clones were grown to saturation and then induced for 48 h at 30° C. with shaking. After induction, yeast cells were pelleted and the supernatants were harvested for purification. IgGs were purified using a Protein A column and eluted with acetic acid, pH 2.0. Fab fragments were generated by papain digestion and purified over KappaSelect (GE Healthcare LifeSciences).

ForteBio $K_D$ Measurements

ForteBio affinity measurements were performed on an Octet RED384 generally as previously described (see, e.g., Estep et al, High throughput solution-based measurement of antibody-antigen affinity and epitope binning. Mabs 5(2), 270-278 (2013), herein incorporated by reference in its entirety). Briefly, ForteBio affinity measurements were performed by loading IgGs on-line onto AHQ sensors. Sensors were equilibrated off-line in assay buffer for 30 min and then monitored on-line for 60 seconds for baseline establishment. Sensors with loaded IgGs were exposed to 100 nM antigen for 3 minutes, and afterwards were transferred to assay buffer for 3 min for off-rate measurement. All kinetics were analyzed using the 1:1 binding model. Recombinant Human IL-27 Protein (R&D Systems Cat: 2526-IL) was used as an antigen. Affinity measurements for anti-IL-27 antibodies is shown in FIG. 1.

ForteBio Epitope Binning/Ligand Blocking

Epitope binning/ligand blocking was performed using a standard sandwich format cross-blocking assay. Control anti-target IgG was loaded onto AHQ sensors and unoccupied Fc-binding sites on the sensor were blocked with an irrelevant human IgG1 antibody. The sensors were then exposed to 100 nM target antigen followed by a second anti-target antibody or ligand. Additional binding by the second antibody or ligand after antigen association indicates an unoccupied epitope (non-competitor), while no binding indicates epitope blocking (competitor or ligand blocking).

MSD-SET Kinetic Assay

Equilibrium affinity measurements performed as previously described (Estep et al., 2013). Solution equilibrium titrations (SET) were performed in PBS+0.1% IgG-Free BSA (PBSF) with antigen held constant at 10-100 pM and incubated with 3- to 5-fold serial dilutions of antibody starting at 5-100 nM (experimental condition is sample dependent). Antibodies (20 nM in PBS) were coated onto standard bind MSD-ECL plates overnight at 4° C. or at room temperature for 30 min Plates were then blocked for 30 min with shaking at 700 rpm, followed by three washes with wash buffer (PBSF+0.05% Tween 20). SET samples were applied and incubated on the plates for 150 s with shaking at 700 rpm followed by one wash. Antigen captured on a plate was detected with 250 ng/mL sulfotag-labeled streptavidin in PBSF by incubation on the plate for 3 min. The plates were washed three times with wash buffer and then read on the MSD Sector Imager 2400 instrument using 1× Read Buffer T with surfactant. The percent free antigen was plotted as a function of titrated antibody in Prism and fit to a quadratic equation to extract the $K_D$. To improve throughput, liquid handling robots were used throughout MSD-SET experiments, including SET sample preparation.

Example 3: Binding of Anti-IL-27 Antibodies to Recombinant Human IL-27

The ability of anti-IL-27 antibodies described in Example 2 to bind to recombinant human IL-27 was assessed by ELISA. Briefly, Nunc MaxiSorp ELISA Plates (Affymetrix #44-2404-21) were coated with 100 µL/well recombinant human IL-27 (R&D Systems #2526-IL/CF) (0.5 µg/mL diluted in PBS), sealed and incubated overnight at 4° C. Plates were washed 3 times with 100 µL/well of wash buffer (PBS+0.01% Tween). Plates were then blocked with 200 µL/well of blocking buffer (PBS+0.1% BSA+0.01% Tween) for 1 hour at room temperature (RT) with shaking. Blocking buffer was decanted and 100 µL per well of diluted control and anti-IL-27 antibodies were added, as indicated. A 10-point serial dilution was created for each antibody by diluting antibodies 1:10 starting from a top concentration of 1 µg/mL. Plates were incubated for 1-2 hours at RT with shaking. Plates were washed 3 times with 100 µL/well of wash buffer. 100 µL/well of anti-human IgG secondary antibody (SouthernBiotech; Cat. #2014-05) was added (1:5000 diluted in blocking buffer). Plates were then incubated for 1 hour at RT with shaking. After the 1 hour incubation, plates were washed 3 times with 100 µL/well of wash buffer. To develop the plates 100 µL/well TMB Buffer (Life Technologies #00-2023) was added. The development of blue color in the wells of the standard curve was observed and as soon as the highest concentration of diluted control antibodies reached a deep blue (5-10 minutes), 50 µL/well STOP Solution (Thermo Fisher #SS04) was added (the color will change to yellow). The developed plates were read at 450 nm (minus 570 nm for wavelength correction) within 30 minutes of stopping the reaction.

As shown in FIG. 2, anti-IL-27 antibodies bind to recombinant human IL-27. An IgG isotype control antibody (IgG Control) was used as a comparator.

For example, biochemical affinity and specificity studies showed that the anti-IL-27 antibody SRF388 binds to the p28 subunit (but not the EBI3 subunit) of the heterodimeric cytokine IL-27. SRF388 bound to human, nonhuman primate, and rodent recombinant IL-27, and the extent of the binding differed between species. The binding specificity of SRF388 to IL-27 was confirmed by testing against a panel of ~4500 cell surface and soluble molecules, and no off-target binding was observed. The binding specificity of IL-27 for its receptor IL-27RA (WSX-1) was also confirmed; no other cell surface receptor bound human IL-27. The ability of SRF388 to block the interaction between human IL-27 and IL-27RA (WSX-1) was confirmed by Surface Plasmon Resonance.

Binding of the antibodies disclosed herein was assessed in several model systems. Since human IL-27 is biologically active on mouse cells, systemic overexpression of human IL-27 in mice using DNA minicircle delivery was utilized to analyze IL-27-mediated effects in vivo by whole-genome microarray analysis, flow cytometry, and serum cytokine analysis. Many of the markers that were modulated by IL-27 in vivo were consistent with findings in human cell-based assays. SRF381 was also evaluated in a disseminated B16 tumor model. In that setting, treatment with SRF381 showed results consistent with phenotypes observed in mice deficient for various components of IL-27 ligand (IL-27 p28, EBI3) or receptor (IL-27RA).

Collectively, these studies demonstrate that SRF388 (and its sibling SRF381) can phenocopy IL 27 deficiency in mice, binds specifically and with high affinity to IL-27 and can inhibit its immunosuppressive effects, either alone or in combination with PD-L1 blocking agents.

Example 4: Anti-IL27 Antibodies Inhibit Phosphorylation of STAT1 In Vitro

IL-27 signaling through the IL-27 receptor (IL-27R) results in the phosphorylation of the Signal Transducer And Activator Of Transcription 1 (STAT1) polypeptide (pSTAT1). Anti-IL-27 antibodies described in Example 2 were tested for their ability to inhibit IL-27-mediated phosphorylation of STAT1 in human whole blood, human PBMCs, the U937 myeloid cells (histiocytic lymphoma cell line) and HUT-78 T cell lymphoma cells by flow cytometry.

Anti-IL-27 antibodies were tested for their ability to inhibit IL-27-mediated phosphorylation of STAT1 in human whole blood. Briefly, EDTA anticoagulated whole human blood, stored at room temperature, was used in this assay. 45 µL blood was distributed into each well of a deep well, round bottom plate (Phenix #850356) and warmed for 30 minutes at 37° C. on a plate warmer (EchoTherm IC20) or in a 37° C. incubator. Anti-IL-27 antibodies were diluted to a 10× top concentration in endotoxin-free PBS (Teknova #P0300) in a polypropylene V-bottom plate (Corning #3363). Anti-IL-27 antibodies were serially diluted as desired in endotoxin-free PBS. PBS alone was added to wells for unstimulated and stimulated controls. 5 µL of each dilution was added to a well of 45 µL blood and mixed by shaking on plate shaker 15 seconds 1000 RPM (Eppendorf Mix Mate). The plate was incubated for 60 minutes at 37° C. on a plate warmer or in a 37° C. incubator.

A 10 µg vial of recombinant human IL-27 (R&D Systems #2526-IL) was reconstituted to 100 µg/mL by adding 100 µL PBS+0.1% BSA (made from 10% BSA Sigma #A1595). A working stock of the recombinant hIL-27 (rhIL-27) was prepared by dilution to 200 ng/mL in endotoxin-free PBS. After the 60-minute incubation, 5 µL of 200 ng/mL rhIL-27 was added to each well of stimulated blood. 5 µL PBS was added to unstimulated control wells. The plate was shaken on a plate shaker for 15 seconds at 1000 RPM. The plate was incubated for 30 minutes at 37° C.

After the 30-minute incubation, cells were fixed. Lyse/Fix reagent (BD #558049) was diluted 1:5 in sterile water (Hyclone #SH3052902) and warmed to 37° C. in a water bath. 500 µL Lyse/Fix reagent was added to each well of the deep well plate and the plate was mixed on a plate shaker for 15 seconds at 1000 RPM. The plate was incubated for 15 min at 37° C.

After the 15-minute incubation, the plate was centrifuged for 5 minutes at 1500 RPM at room temperature (Eppendorf centrifuge 5810R) and supernatant was discarded by flicking. 1 mL of endotoxin-free PBS was added per well and the plate was shaken on plate shaker for 15 seconds at 1000 RPM. The plate was centrifuged for 5 minutes at 1500 RPM at room temperature (Eppendorf centrifuge 5810R) and supernatant was discarded by flicking. Cell pellets remained in the plate.

Cell pellets were resuspended in 50 µL 1:200 CD14-Pacific Blue (Biolegend #325616) in FACS Buffer (PBS, Gibco #14190-144/2% FBS, Sigma #F8317/1 mM EDTA, Fisher #BP2482) and transferred to U-bottom 96 well plate (Costar #3799). The plate was sealed with plate sealer (VWR #89134-432) and incubated for 30 minutes at room temperature in the dark.

After the 30 minute incubation, 150 µL FACS buffer was added to each well and the plate was centrifuged at 1500 RPM for 5 minutes at room temperature. The cell pellets were then resuspended in 100 µL Perm III (stored at −20° C.) (BD #558050) with pipetting and the plate was sealed with plate sealer and lid. The plate was incubated overnight at −20° C. or 15 minutes at 4° C. After the incubation, 150 µL PBS was added and the plate was centrifuged at 1500 RPM for 5 minutes at room temperature. The supernatant was discarded from the plate by flicking and the plate was resuspended in 50 µL staining cocktail prepared as described in the Table 6 below:

TABLE 6

| BD Catalog # | Antibody | Color | Dilution |
|---|---|---|---|
| 561807 | CD3 | FITC | 1:10 |
| 562069 | pSTAT1 Y701 | PE | 1:100 |
| 562071 | pSTAT3 Y705 | APC | 1:20 |

The plate was incubated for 1 hour at room temperature in the dark. After the 1-hour incubation, 100 µL of FACS buffer was added and the plate was centrifuged at 1500 RPM for 5 minutes at room temperature. The supernatant was discarded from the plate by flicking and the plate was resuspended in 100 µL FACS buffer for analysis by flow cytometry.

Figure 3A:
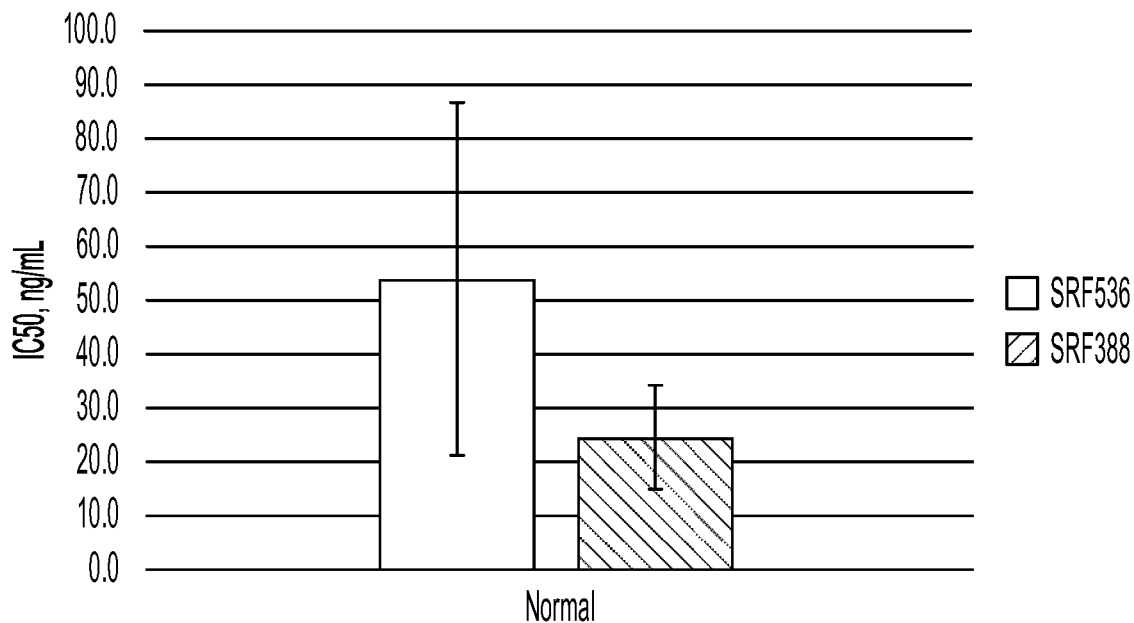
FIGS. 3A-3E are a bar chart, two graphs, a bar chart, and a graph, respectively.

As shown in FIG. 3A, anti-IL-27 antibodies inhibit the phosphorylation of STAT1 in human whole blood. The anti-IL-27 antibody Ab14 inhibited the phosphorylation of STAT1 at an $IC_{50}$ of 24.7 ng/mL—in human whole blood.

The anti-IL-27 antibodies described in Example 2 were further tested for their ability to inhibit IL-27-mediated phosphorylation of STAT1 in pooled human PBMCs by flow cytometry. Briefly, frozen cryovials of human PBMC's (peripheral blood mononuclear cells), obtained from buffy coats, were removed from liquid nitrogen storage and quickly thawed in a 37° C. water bath. The contents of each cryovial was removed with a P1000 pipet and transferred to a 15 mL conical falcon tube. 2-3 mLs of complete RPMI-1640 (Gibco, 61870-036) was slowly added to the thawed cells and cells were gently swirled or flicked to suspend. Conical tubes were topped-off up to 10 mLs with complete RPMI-1640 and tubes were inverted to mix. Conical tubes were centrifuged tube at 1400 RPM at room temperature for 8 minutes.

PBMC cells were resuspended at a density of 4 million cells per mL in warm, serum-free RPMI-1640 and plated at a density of 200,000 cells per well (500 in a round bottom 96-well plate (Costar, 3799). Anti-IL-27 antibodies were diluted in serum-free RPMI-1640 in the first row of a 96-well polypropylene plate to a top concentration of 40 µg/ml (will be 10 µg/ml final). Serial dilutions as desired (1:2, 1:3, etc. . . . ) were made in the remainder of the first 10 rows of the plate. Fifty microliters (µL) of the antibody stock (4×) was added to the first 10 rows the plate of PBMC cells in the round bottom plate. In rows 11 and 12, 50 µL of serum-free RPMI-1640 cell media was added. The plate was then incubated at 37° C. for 2 hours.

After the 2-hour incubation, 100µ of 50 ng/ml recombinant human IL-27 (R&D Systems, 2526-IL) diluted in serum-free RPMI-1640 cell media was added to each well (except, the control wells which included serum-free media alone or antibody alone) for a final concentration of 25 ng/ml. 100 µL serum-free RPMI-1640 cell media was added to control wells or wells with antibody alone. The plate was incubated for 20 minutes at 37° C.

After the 20-minute incubation, 50 µL of 4% PFA (Pierce, 28906) in DI water was added directly to each well and the plate was incubated at 37° C. for 5 minutes to fix the cells. The plate was centrifuged at 2000 RPM for 5 minutes. Media was discarded by flicking and plate was washed with 150 µL DPBS. The washing steps were repeated 2 more times. 50µ ice cold 90% methanol (MeOH) (Sigma, 439193) diluted in $H_2O$ was added quickly to each well using a 12-channel pipette. When adding the MeOH special care was taken to mix each well. The plate was incubated at 20° C. for at least 15 minutes. 100 µL of DPBS was added to each well on top of the 90% methanol and the plate was centrifuged at 2000 RPM for 5 minutes. Plate contents were discarded by flicking and the plate was washed 3 times as described previously. After the last wash, cell pellets remained in the wells of the plate.

The pelleted PBMC's were stained with pSTAT1 PE (BD Phosflow, 526069) 1:100 in FACS buffer (2% FBS, 2 mM EDTA in DPBS) for 45 minutes at room temperature in the dark. Special care was taken to mix each well with a 12-channel pipette when adding the stain. After the 45-minute incubation, 100 µL FACS buffer was added into each well and the plate was centrifuged at 2000 RPM for 5 minutes. Supernatant was discarded by flicking and the plate was washed 2 times as described previously. Cells were resuspended in 100 µL FACS buffer and analyzed by flow cytometry.

Figure 3B:
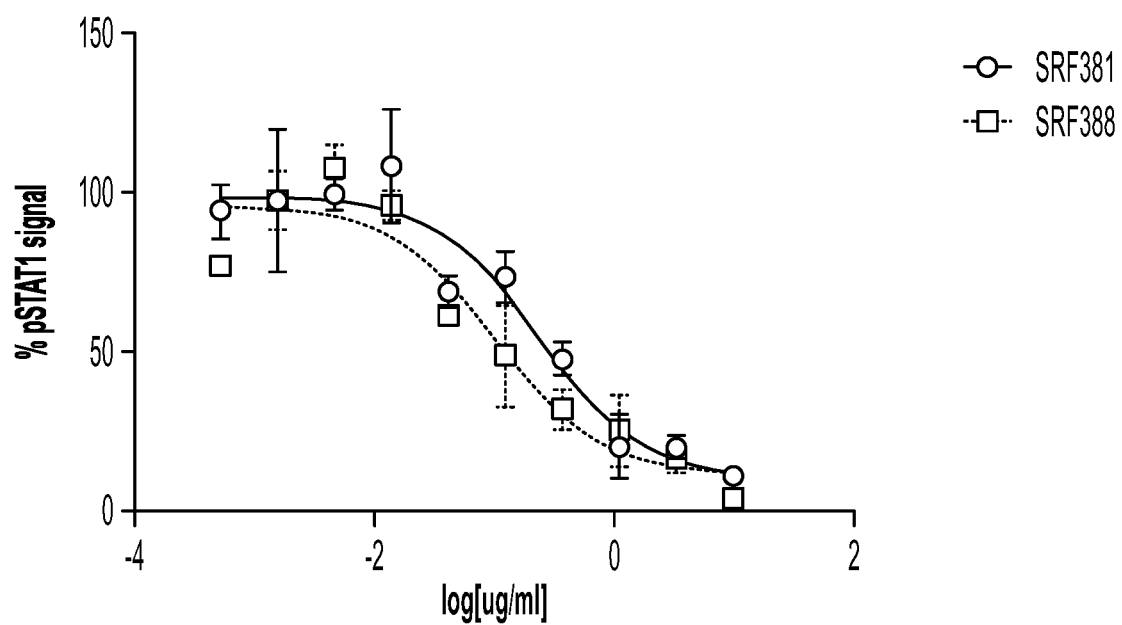

As shown in FIG. 3B, anti-IL-27 antibodies inhibited phosphorylation of STAT1 in human pooled PBMCs. The anti-IL-27 antibody SRF381 inhibited phosphorylation of STAT1 at an average $IC_{50}$ of 140.5 ng/ml (n=2) in pooled human PBMCs. The anti-IL-27 antibody SRF388 inhibited phosphorylation of STAT1 at an average $IC_{50}$ of 58.3 ng/ml (n=3) in pooled human PBMCs.

Figure 3C:
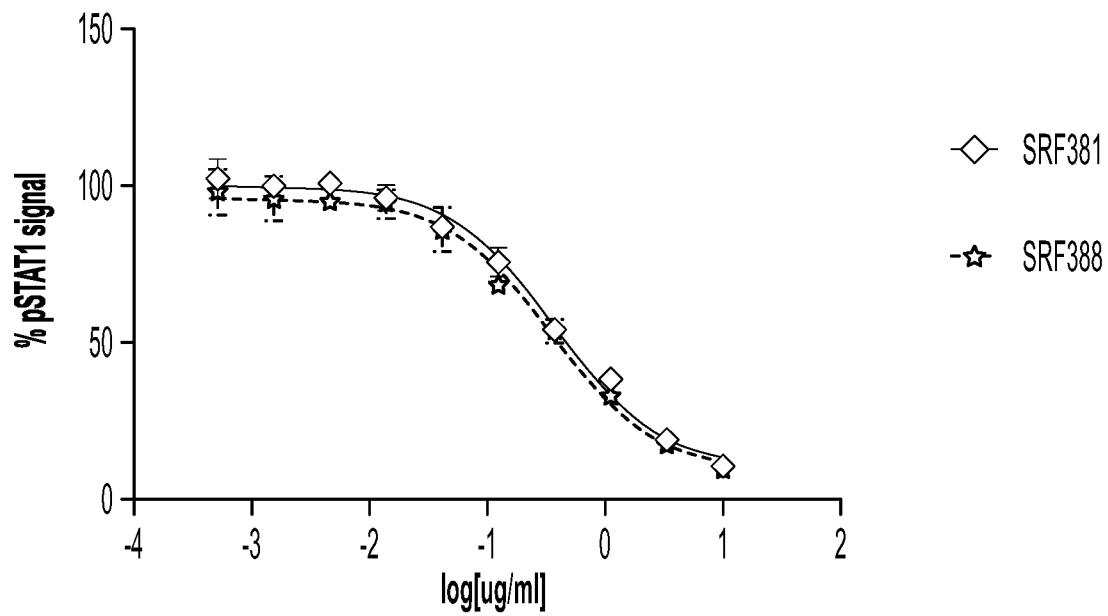

Anti-IL-27 antibodies were further tested for their ability to inhibit IL-27-mediated phosphorylation of STAT1 in U937 cells, a cell line known to express Fc receptors, by flow cytometry essentially as described for FIG. 3B. As shown in FIG. 3C, anti-IL-27 antibodies inhibit the phosphorylation of STAT1 in U-937 cells, as indicated. Antibody SRF381 inhibited the phosphorylation of STAT1 at an average $IC_{50}$ of 81 ng/ml (n=2) in U937 cells. Antibody SRF388 inhibited the phosphorylation of STAT1 at an average $IC_{50}$ of 96 ng/ml (n=2) in U937 cells.

Figure 3D:
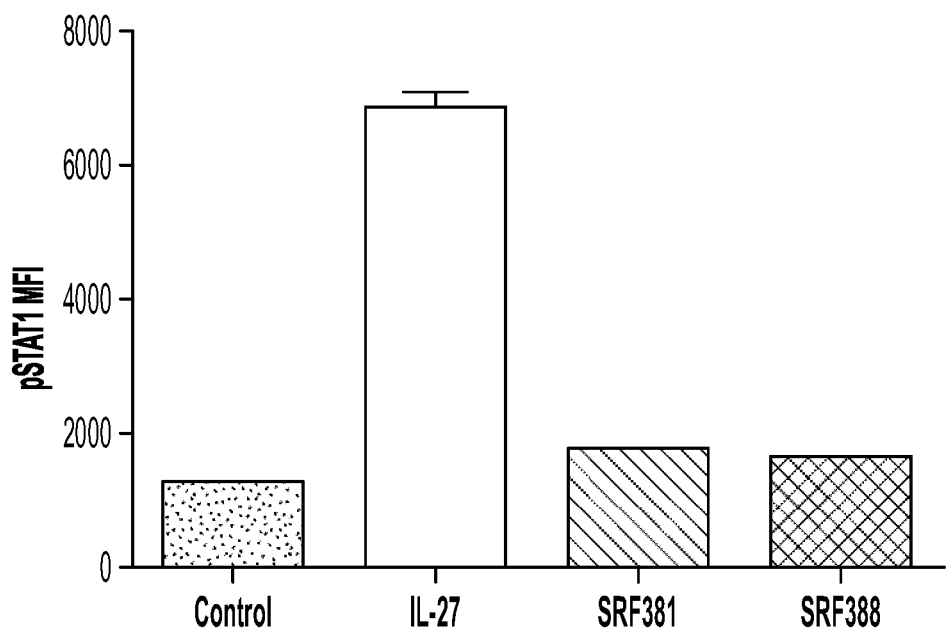

Anti-IL-27 antibodies were tested for their ability to inhibit IL-27-mediated phosphorylation of STAT1 in the cutaneous T-cell lymphoma line HUT-78, which does not express cell surface Fc receptors, by flow cytometry essentially as described for FIG. 3B. As shown in FIG. 3D, anti-IL-27 antibodies inhibited the phosphorylation of STAT1 in HUT-78 cells. Antibody SRF381 inhibited the phosphorylation of STAT1 at an IC50 of 80 ng/ml (n=1) in HUT-78 cells. Antibody SRF388 inhibited the phosphorylation of STAT1 at an $IC_{50}$ of 95 ng/ml (n=1) in HUT-78 cells.

The present disclosure also assessed IL-27 inhibition by SRF388 across species in a whole blood assay. To characterize SRF388 activity across species, recombinant IL-27 from human, cynomolgus monkey, rat, and mouse was tested to stimulate pSTAT1 signaling in T lymphocytes from whole blood samples obtained from these species (data not shown).

Briefly, whole blood was warmed to 37° C. followed by a 60-minute pre-incubation with SRF388, and 20 ng/mL of human IL-27 was added. Samples were incubated for another 30 minutes. White blood cells were fixed, and red blood cells were lysed. After washing, fixed cells were permeabilized and stained with anti-CD3 and anti-phospho-STAT1 (Y701). After a 1-hour incubation, samples were washed and resuspended for flow cytometry. Percent inhibition was calculated using stimulated and unstimulated control wells, and IC50 values were calculated using Graph-Pad Prism.

Figure 3E:
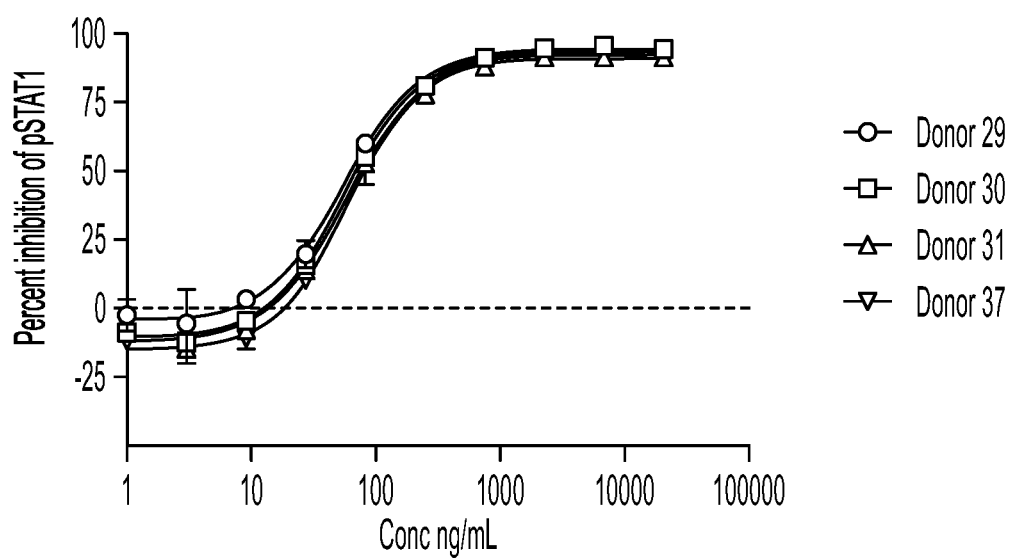

Representative data for SRF388 signaling inhibition in human T cells are shown in FIG. 3E. Consistent with observations made on the affinity of SRF388 to different species, the potency of IL-27 signaling inhibition by SRF388 was strongest in human, followed by cynomolgus monkey, rat, and mouse (see e.g., Table 7).

TABLE 7

SRF388 $IC_{50}$ Values in Peripheral Blood T Cells from Different Species

| Species | Average $IC_{50}$, ng/mL | Standard Deviation | Number |
|---|---|---|---|
| Human | 78.4 | 35 | 7 |
| Cynomolgus monkey | 118.1 | 36.4 | 4 |
| Rat | 273.2 | 133.5 | 8 |
| Mouse | 1721 | N/A | 1 (pool of 10) |

Abbreviations: $IC_{50}$ = half maximal inhibitory concentration, N/A = not applicable Example 5: Reduction of IL-27-Mediated Inhibition of CD161 by Anti-IL-27 Antibodies The C-type lectin CD161 is a marker of T cells whose expression is suppressed by IL-27. Anti-IL-27 antibodies described in Example 2 were tested for their ability to reverse the IL-27-mediated inhibition of CD161 in pooled human PBMC cells by flow cytometry. Briefly, frozen cryovials of pooled human PBMC's (peripheral blood mononuclear cells), obtained from buffy coats, were removed from liquid nitrogen storage and quickly thawed in a 37° C. water bath. Contents of each cryovial was removed with a P1000 pipet and transferred to a 15 mL conical falcon tube. 2-3 mLs of complete RPMI-1640 (Gibco, 61870-036) was slowly added to the thawed cells and cells were gently swirled or flicked to suspend. Conical tubes were topped-off up to 10 mLs with complete RPMI-1640 and tubes were inverted to mix. Conical tubes were centrifuged tube at 1400 RPM, room temperature for 8 minutes.

Use of outer walls was avoided to minimize the effects of evaporation during the 5-day assay. Outer wells should be filled with 200 μL per well of DPBS (Gibco, 14190-144). PBMC cells were resuspended at a density of 2 million cells per mL in warm, complete RPMI-1640. Purified human anti-CD3 antibody (Biolegend, UCTH1, #300402) was added at a concentration of 0.5 μg/mL (this is 2× the final concentration). Plate 100 μL per well of this cell mixture (200,000 cells per well) in a round bottom 96 well plate (Costar, 3799).

Anti-IL-27 antibodies were diluted in complete RPMI-1640 in the first row of a 96 well polypropylene plate to a top concentration of 40 μg/ml (will be 10 ug/ml final). Serial dilutions as desired (1:2, 1:3, etc. . . . ) were made in the remainder of the first 10 rows of the plate. 50 μL of the antibody stock (4×) was added to the first 10 rows the plate of PBMC cells in the round bottom plate. In rows 11 and 12, 50 μL of complete RPMI-1640 was added.

After the addition of the anti-IL-27 antibodies, 50 μl of 100 ng/ml recombinant human IL-27 (R&D Systems, #2526-IL) diluted in complete RPMI-1640 was added to each well (except control wells which included serum free media or antibody alone) for a final concentration of 25 ng/ml. Fifty μL of complete RPMI-1640 was added to control wells. The plate was incubated for 5 days at 37.0 in a tissue culture incubator with minimal interference.

After the 5-day incubation the plate was removed from the incubator and agitated on a plate shaker for 30 seconds at 600 RPM. The plate was centrifuged at 1800 RPM for 5 minutes. Media was removed and set aside for additional assays and the plate was washed with 150 μL DPBS (Gibco, #14190-144). The washing steps were repeated 2 more times. The cell pellets were stained with 50 μL per well of staining cocktail as described in the Table 8 below:

TABLE 8

| Biolegend Catalog # | Antibody Target | Color | Dilution |
|---|---|---|---|
| 300532 | CD4 | BV421 | 1:100 |
| 304204 | CD45R0 | FITC | 1:100 |
| 339910 | CD161 | AF647 | 1:100 |
| 353410 | CCR6 | PE | 1:100 |

The plate agitated on a plate shaker for 30 seconds at 600 RPM and the plate was incubated for 30 minutes at room temperature in the dark.

After the 30-minute incubation the plate was centrifuged and supernatant was discarded by flicking. The plate was washed 2 times as described previously. After the last wash, cell pellets were fixed by adding 50 μL 4% PFA (Pierce, 28906) in DI water at room temperature for 10 mins. 100 μL of FASC buffer was added to each well, and the plate was centrifuged at 1800 RPM for 5 minutes. Cells were resuspended in 100 μL FACS buffer and read by flow cytometry.

Figure 4:
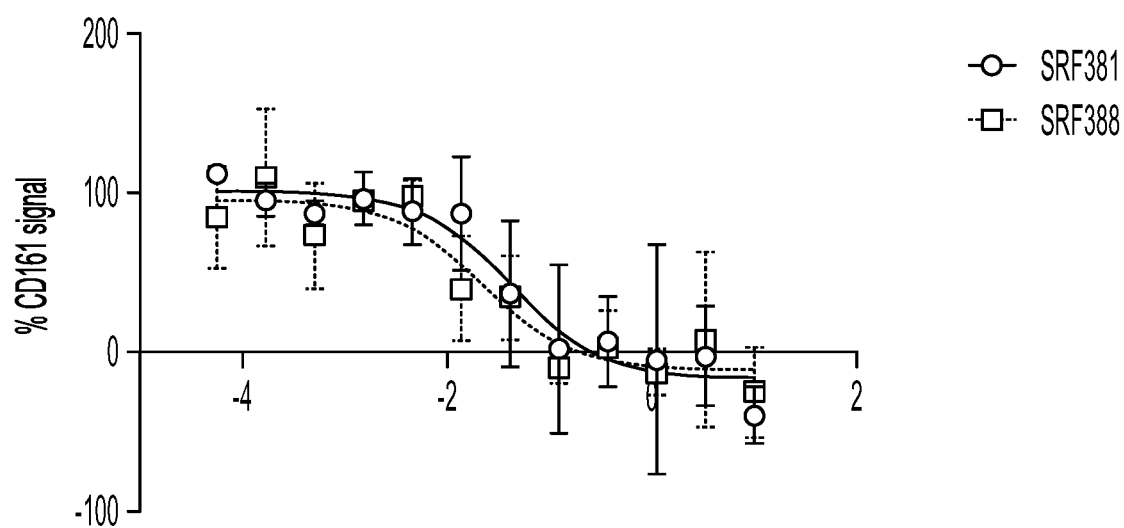
FIG. 4 is a graph of the reversal of IL-27-mediated inhibition of CD161 expression in T cells by a range of concentrations of anti-IL-27 antibodies, as indicated. CD161 expression was determined using flow cytometry.

As shown in FIG. 4, anti-IL-27 antibodies, as indicated, reduce the IL-27 mediated inhibition of CD161.

Figure 5A:
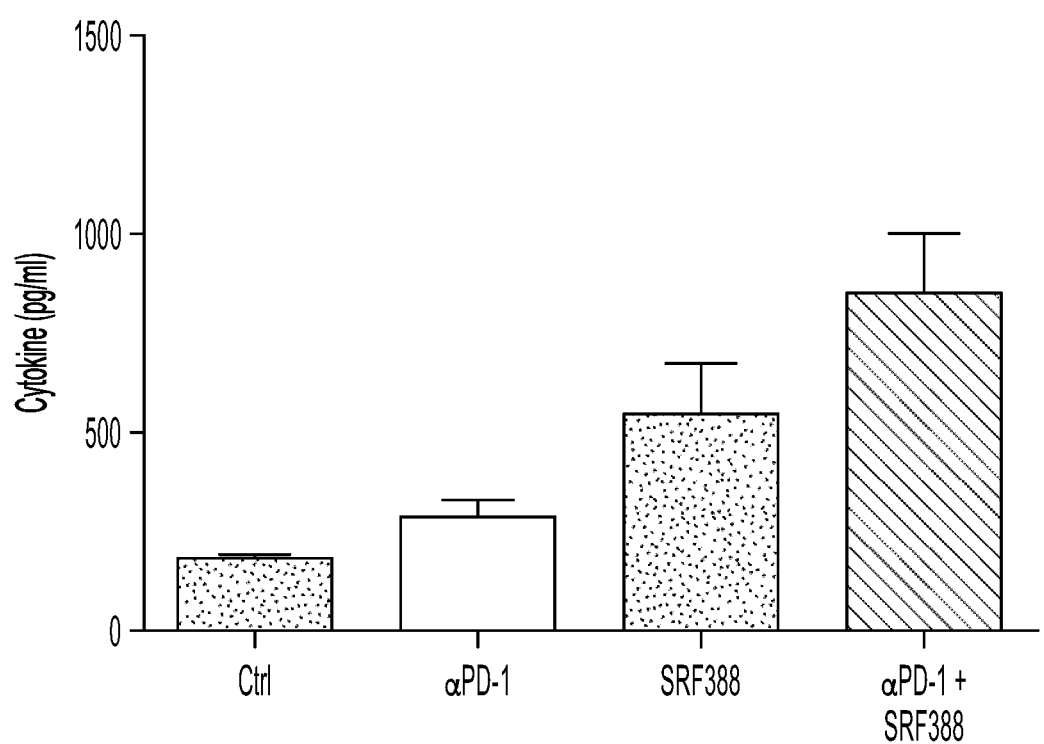
FIG. 5A is a graph depicting the extent of anti-IL-27 antibodies to enhance the PD-1-mediated secretion of TNFα in human PBMCs as measured by ELISA.
Figure 5B:
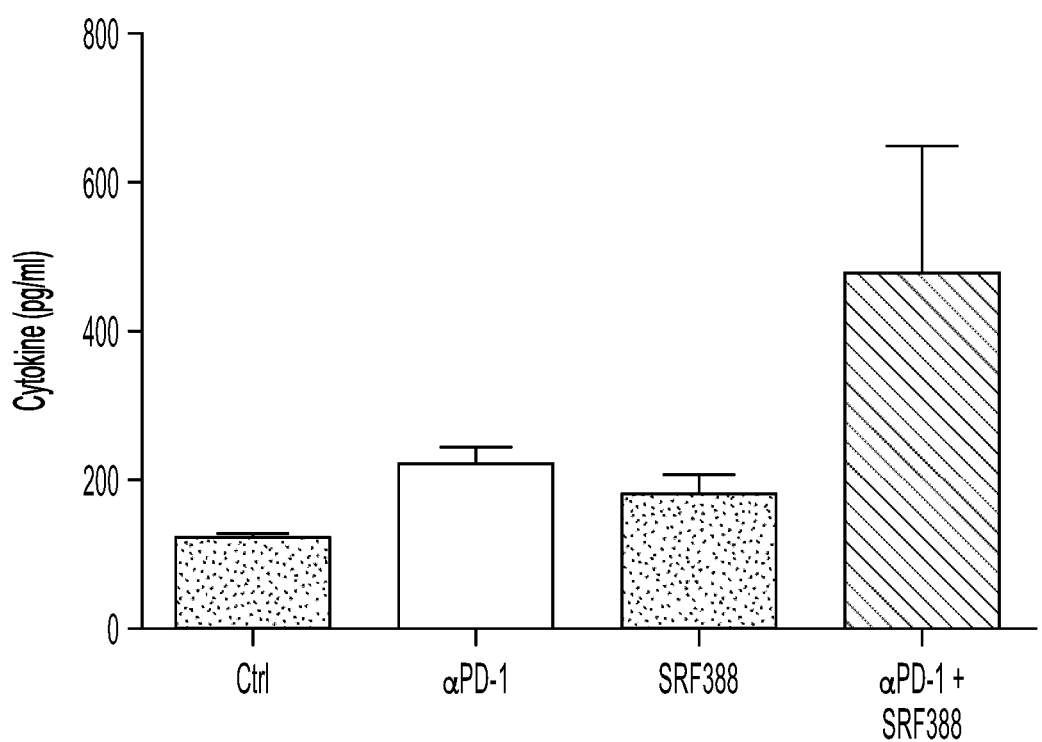
FIG. 5B is a graph depicting the extent of anti-IL-27 antibodies to enhance the PD-1-mediated secretion of IL-6 in human PBMCs as measured by ELISA.

Example 6: Enhancement of PD-1-Mediated Secretion of TNFα, IL-6 and Other Cytokines by Anti-IL-27 Antibodies, Including Additional In Vitro Characterization of Anti-IL-27 Antibodies Anti-IL-27 antibodies were tested for their ability to enhance PD-1-mediated secretion of TNFα and IL-6 in human PBMC cells from cancer patients. Human PBMC cells from cancer patients were cultured essentially as described in Example 5 with the addition of wells also receiving anti-PD-1 antibody, as indicated, at 1 μg/mL. Supernatants from the assay were analyzed for TNFα and IL-6 using Human CBA Th1/Th2/Th17 Kit (BD, 560484). As shown in FIGS. 5A and 5B, anti-IL-27 antibodies enhance the PD-1-mediated secretion of TNFα and IL-6 in pooled human PBMC cells.

The techniques herein also show cytokine-inducing activity of SRF388 monotherapy and in combination with anti-PD-1 in human PBMCs. IL-27 is known to negatively regulate the expression of several inflammatory cytokines. To determine the effects of IL-27 blockade on cytokine production, human PBMCs from healthy donors, patients with RCC, and patients with ovarian cancer were activated with anti-CD3 in the presence or absence of SRF388 for several days and tested for levels of secreted cytokines including IL-17, IFNγ, TNFα, and IL-6. Briefly, PBMCs isolated from fresh whole blood from 4 healthy donors, 5 patients with RCC, and 2 patients with ovarian cancer were activated by 0.25 µg/mL anti-CD3 antibody in the absence or presence of SRF388 (1 µg/mL), anti PD 1 (pembrolizumab, 1 µg/mL) or both antibodies. After 5 days, supernatants were collected and tested for levels of TNFα (A) or IFNγ (B) by MSD or CBA. Data shown represent the fold-change in cytokine production compared to anti-CD3 stimulation alone. Statistics were calculated by paired t-test (*p<0.005).

Figure 5C:
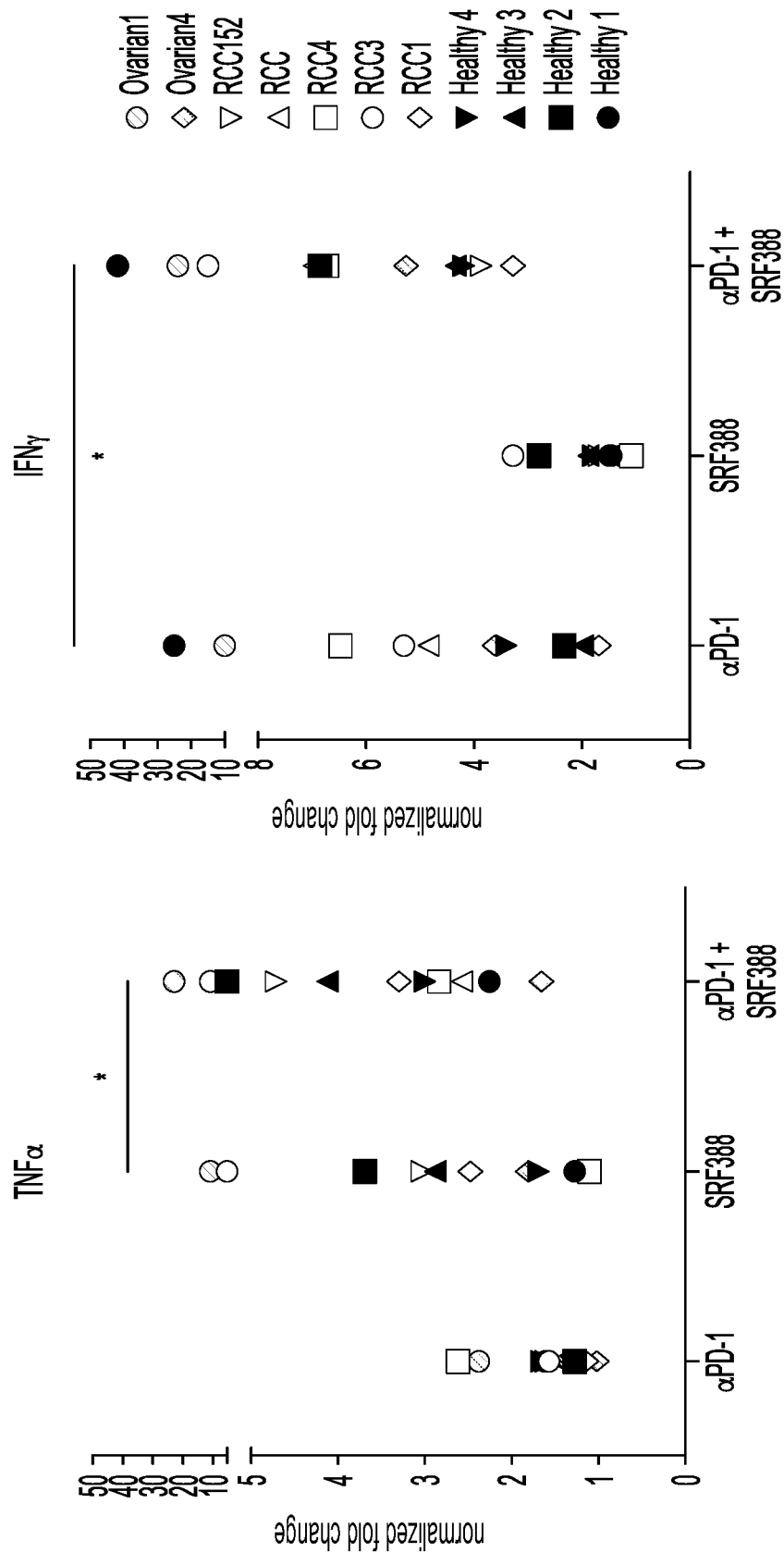
FIG. 5C is a dotplot showing that SRF388 in combination with PD-1 blockade leads to increased cytokine production in PBMCs from healthy donors and patients with RCC (Abbreviations: CBA=Cytometric Bead Array, IFNγ=interferon gamma, MSD=Meso Scale Discovery, PBMCs=peripheral blood mononuclear cells, PD-1=programmed death receptor-1, RCC=renal cell carcinoma, TNFα=tumor necrosis factor alpha).

Anti-PD-1 antibody was used as a control in these assays and the combination of PD-1 and IL-27 blockade was also explored as shown in FIG. 5C. SRF388 treatment led to increased TNF a production in 6 of 11 PBMC samples tested (determined by >2 fold increase) including 2 of 4 healthy donors, 3 of 5 patients with RCC, and 1 of 2 patients with ovarian cancer. When tested in a subset of donors this activity was SRF388 dose dependent (data not shown). Anti-PD-1 (pembrolizumab) treatment showed an increase in TNFα in 2 of the 11 donors tested (1 of 5 RCC and 1 of 2 ovarian cancer) while the combination of SRF388 and anti-PD-1 led to an increase in 10 of 11 donors. The increased TNFα seen in the combination treatment conditions appeared to be additive in 8 of 10 responders. An additive effect for IFNγ production was observed in these cultures after SRF388 and anti-PD-1 treatment (10 of 11 donors); however, responses to anti-PD-1 treatment alone were more frequently seen (10 of 11 donors) compared to SRF388 (2 of 11 donors). Together, these data suggest that SRF388 increases TNFα levels in activated PBMC cultures from healthy donors and patients with cancer and the combination of SRF388 and anti-PD-1 treatment leads to higher levels of TNFα and IFNγ compared to either treatment alone.

Figure 5D:
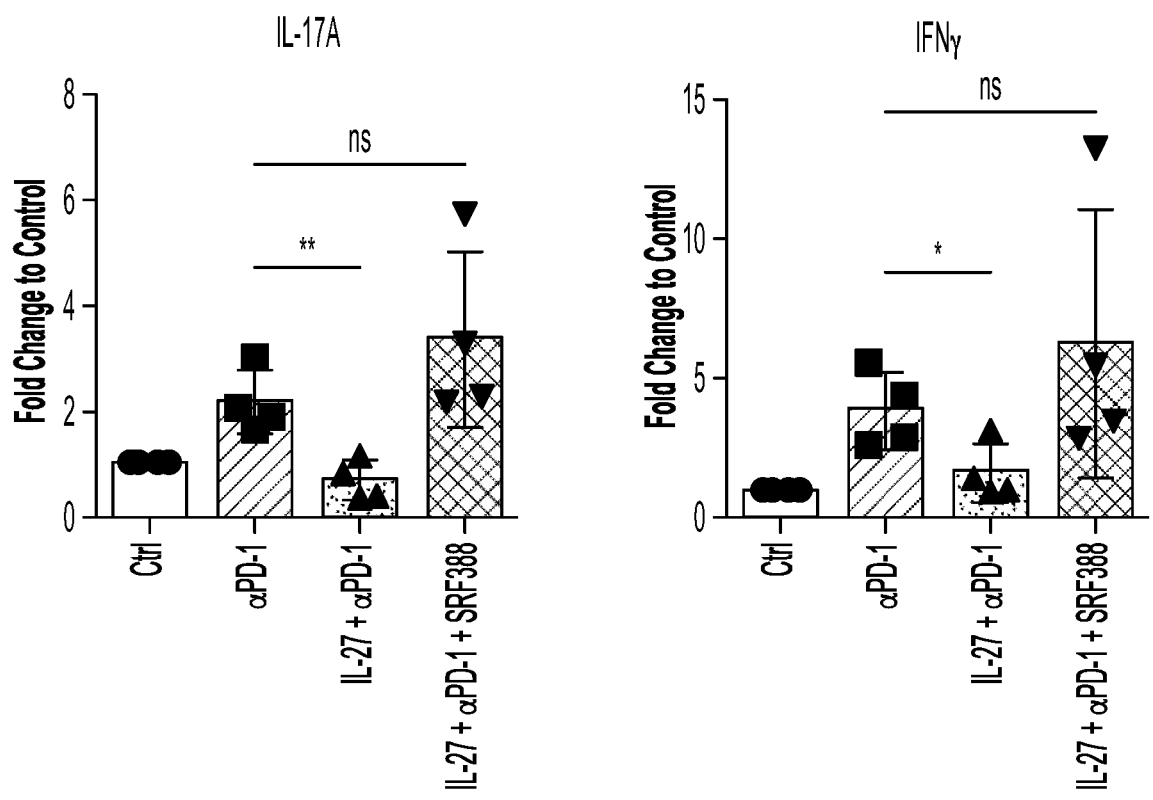
FIG. 5D shows that IL-27 inhibits cytokine production following PD-1 blockade and is restored in combination with SRF388 (Abbreviations: Ctrl=control, ns=not significant, PBMCs=peripheral blood mononuclear cells, rhIL-27=recombinant human IL-27).

To further explore the role of IL-27 and PD-1 blockade, the same activated PBMC culture system was used to determine whether IL-27 could directly counteract the effect of increased cytokine production caused by PD-1 blockade. Briefly, freshly isolated PBMCs from human whole blood were activated by 0.25 µg/mL anti-CD3 antibody. Cells were treated either control IgG1 (1 µg/mL), αPD-1 antibody (pembrolizumab, 1 µg/mL) alone, rhIL-27 (25 ng/mL) plus αPD-1 or rhIL-27 plus αPD-1 with SRF388 (1 µg/mL) at 37° C. for 5 days. Supernatants were collected for CBA detection. The example cytokines (IL-17A and IFNγ) from 4 healthy donors were shown as fold change to control. Mean and standard deviation were depicted. Statistics were calculated by paired t-test (* p<0.05, ** p<0.01). Similar results were also seen in PBMCs from patients with RCC.PD-1 blockade increased both IL-17 and IFNγ in these cultures and IL-27 could completely inhibit this activity, a response that was reversed in the presence of SRF388 as shown in FIG. 5D. These data show that IL-27 can attenuate the effects of anti PD-1 treatment on cytokine production.

Therefore, IL-27 was shown to inhibit anti-PD-1 mediated pro-inflammatory cytokine production in activated human PBMCs, a property that was blocked by SRF388. Moreover, SRF388 in combination with PD-1 blockade led to increased cytokine production in activated PBMCs from healthy donors and patients with RCC. Thus, by blocking IL-27, SRF388 enhances immune cell activation by altering immunoregulatory receptor expression and increasing inflammatory cytokine production.

Figure 5E:
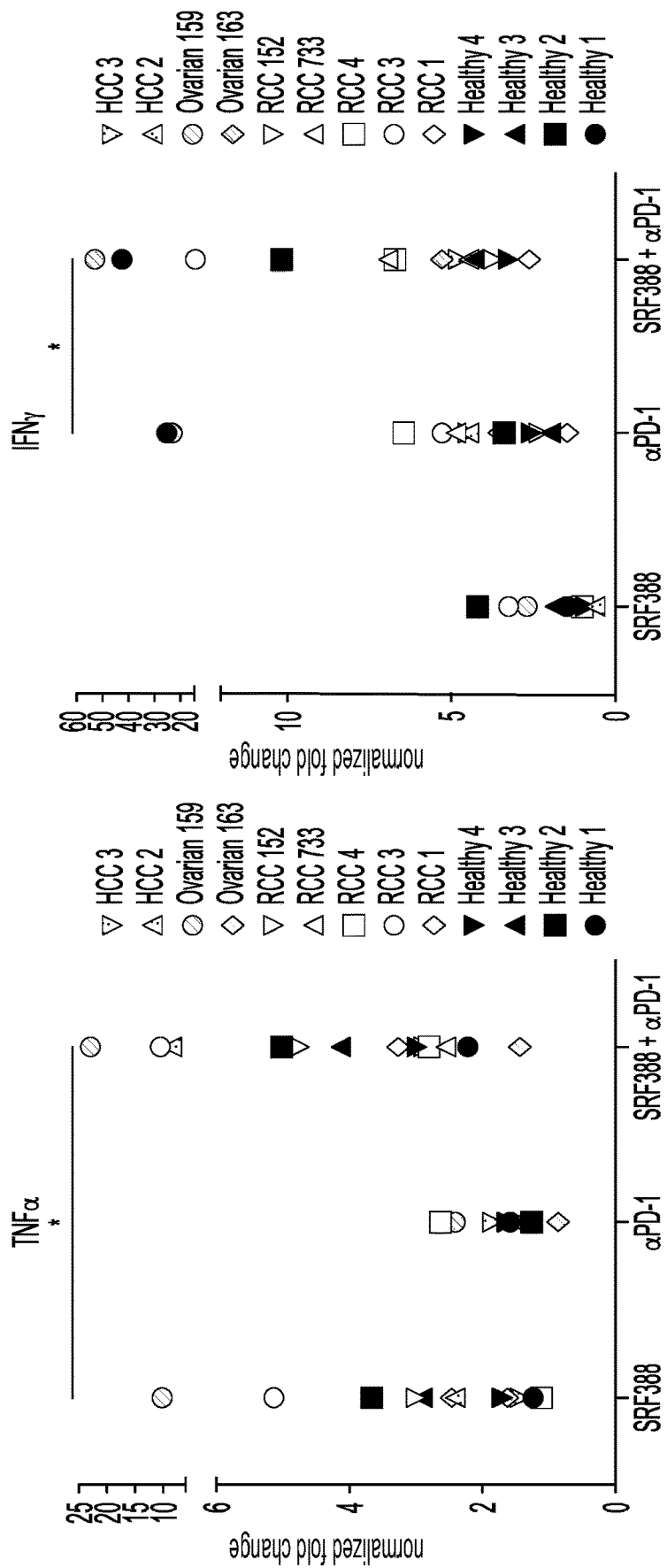
FIG. 5E summarizes observed cytokine induction (specifically, TNFα, IFNγ, IL-6 and IL-17A) in PBMC culture for various indicated types of cells, when such cells were contacted with SRF388 antibody, αPD-1 antibody, or a combination of SRF388 and αPD-1 antibodies.
Figure 5E:
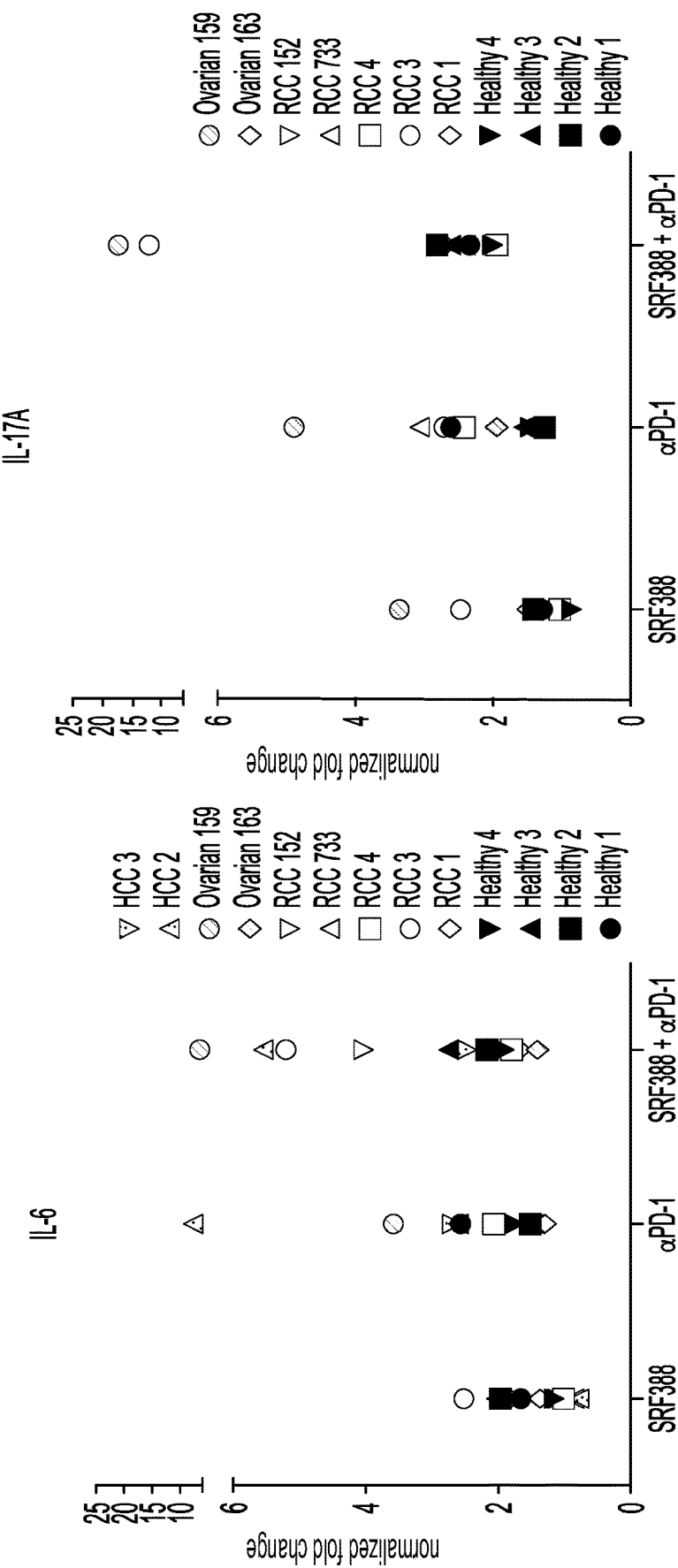
Figure 5F:
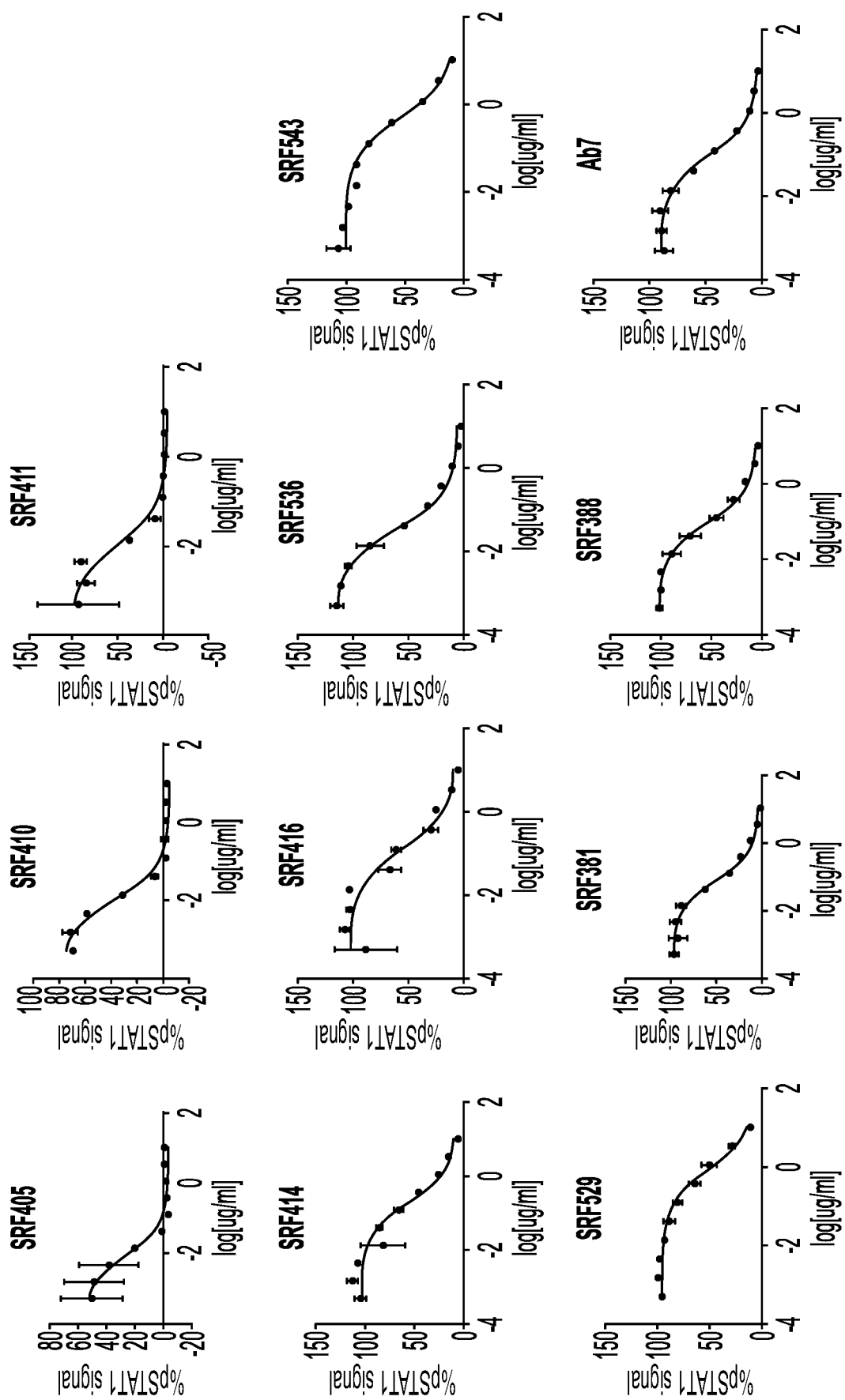
FIG. 5F shows the impact upon pSTAT1 signal in U937 (lymphoma) cells of varying concentrations of the individual antibodies indicated (SRF405, SRF410, SRF411, SRF414, SRF416, SRF536, SRF543, SRF529, SRF381, SRF388 and Ab7).
Figure 5G:
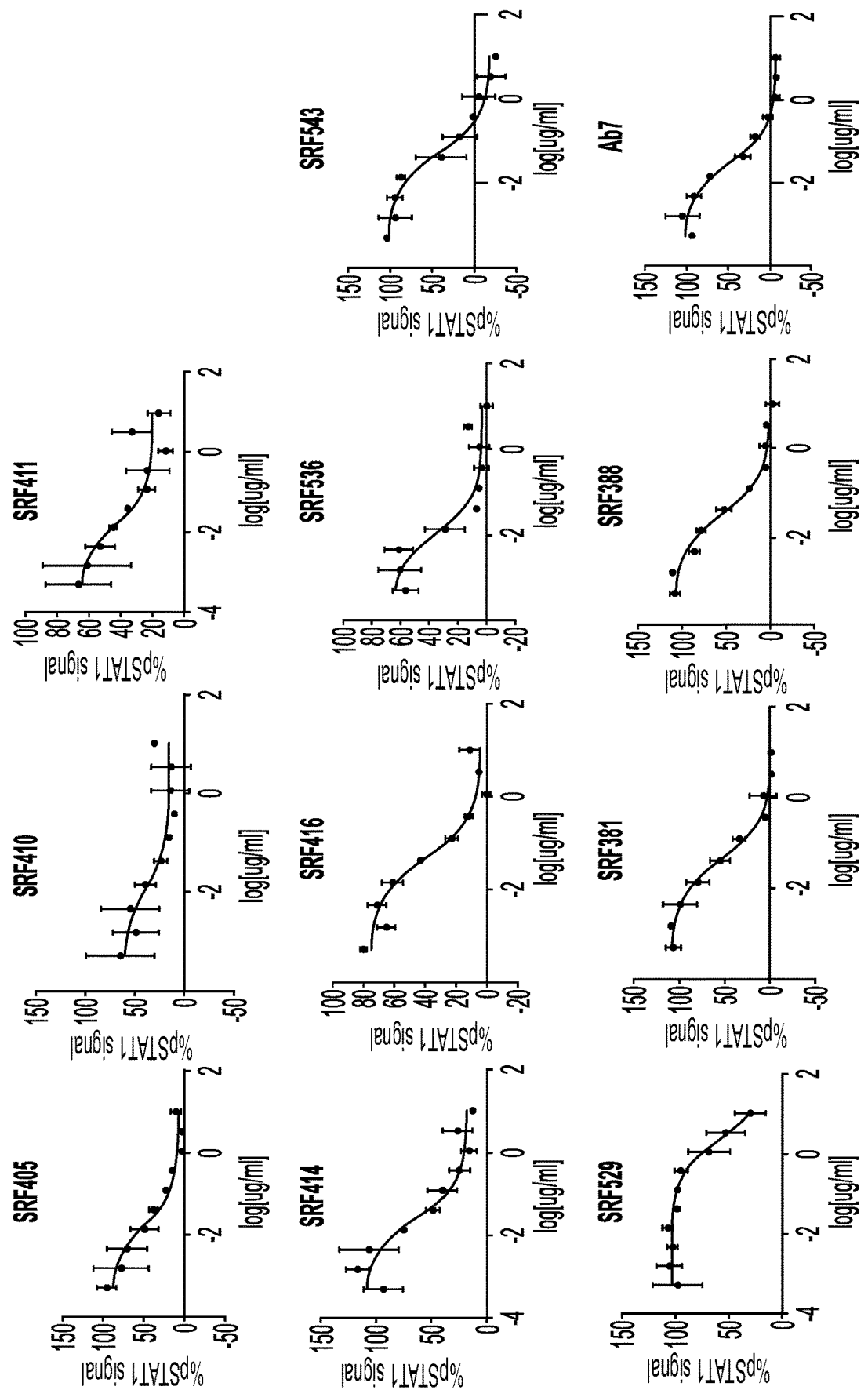
FIG. 5G shows the impact upon pSTAT1 signal in PBMCs (peripheral blood mononuclear cells) of varying concentrations of these individual antibodies.
Figure 5H:
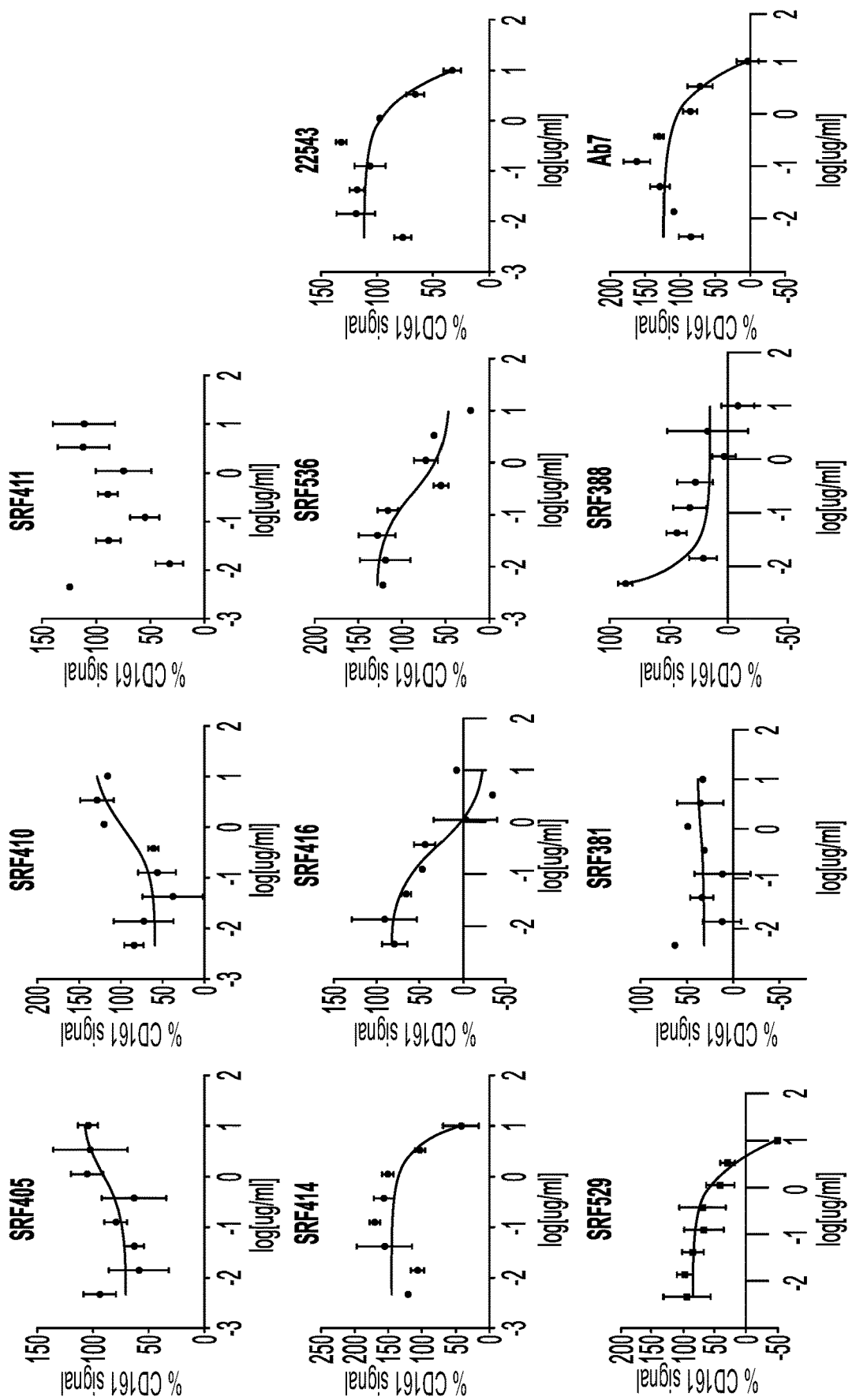
FIG. 5H shows the impact upon CD161 signal in PBMCs (peripheral blood mononuclear cells) of varying concentrations of these individual antibodies.
Figure 5I:
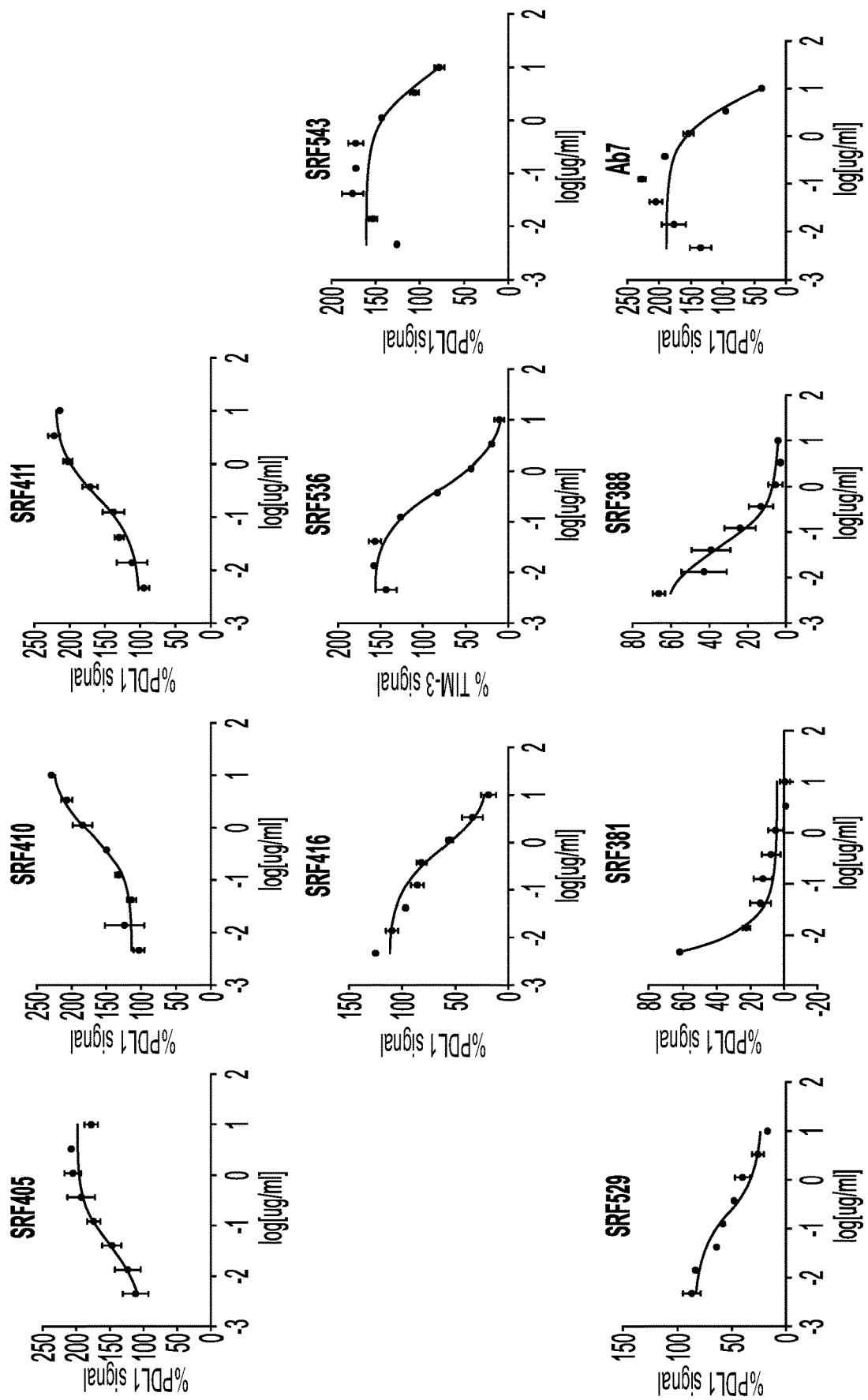
FIG. 5I shows the impact upon PD-L1 signal in CD4 T lymphocytes (CD4 cells) of varying concentrations of these individual antibodies (excluding SRF414).
Figure 5J:
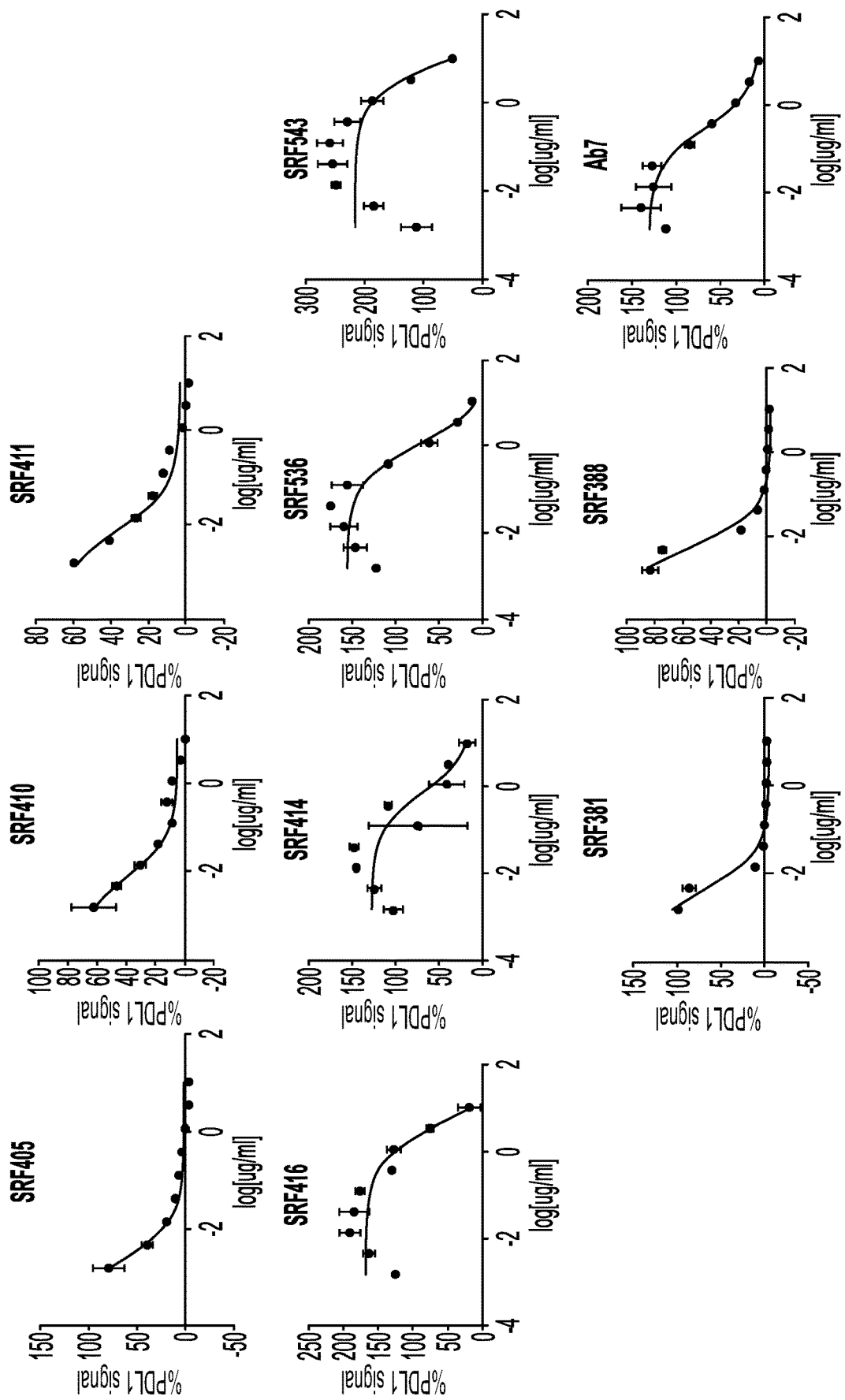
FIG. 5J shows the impact upon PD-L1 signal in monocytes of varying concentrations of these individual antibodies (excluding SRF529).
Figure 5K:
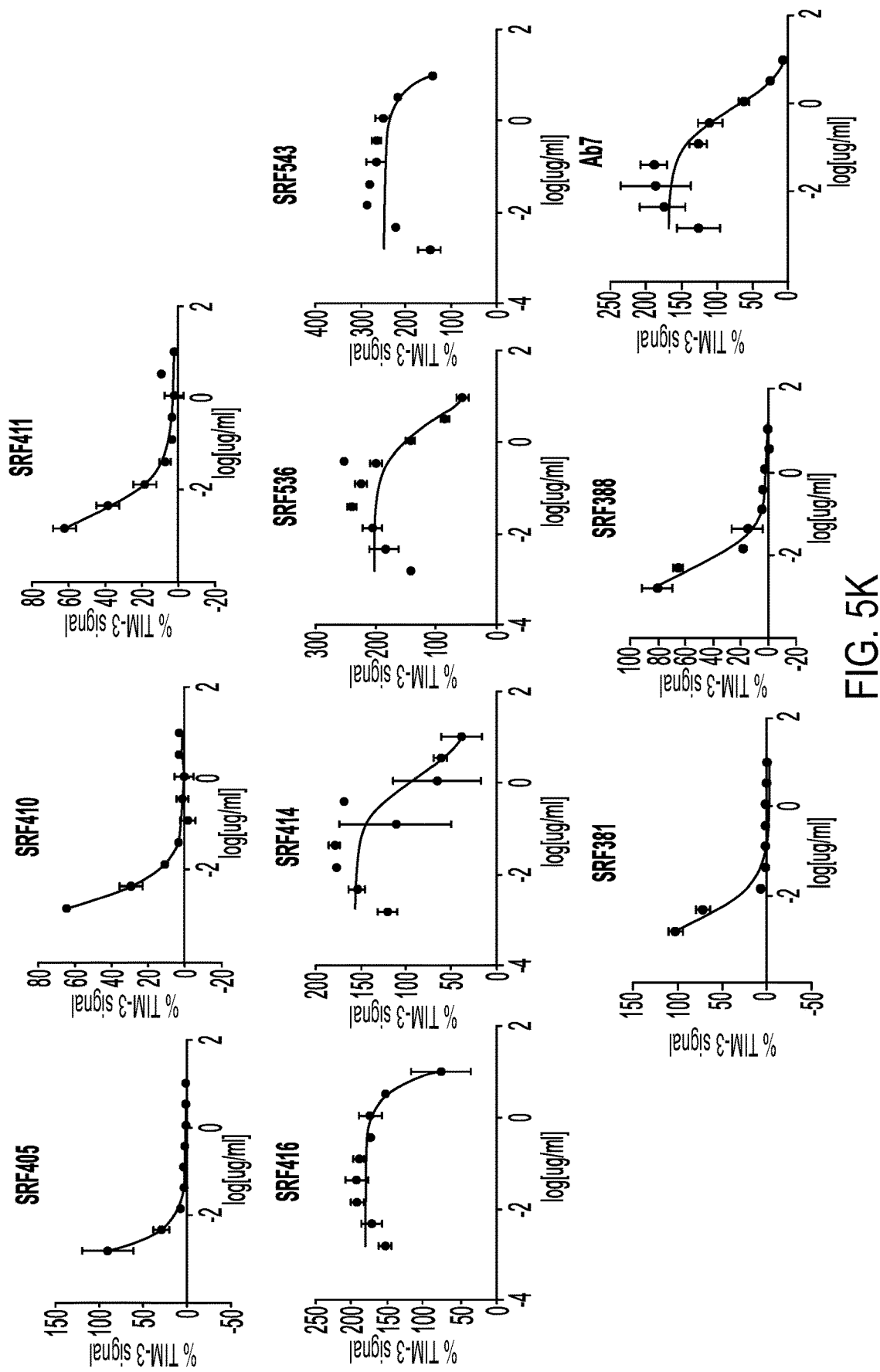
FIG. 5K shows the impact upon TIM-3 signal in monocytes of varying concentrations of these individual antibodies (excluding SRF529).

In additional characterization of individual anti-IL-27 antibodies in the presence of anti-IL-27 antibody (here, SRF388), αPD-1 antibody, or combined anti-IL-27 and αPD-1 antibodies, further characterization of cytokine induction/secretion was performed (FIG. 5E, specifically for TNFα, IFNγ, IL-6 and IL-17A). In vitro dose-response curves were also obtained across a number of IL-27-mediated signaling effects for SRF405, SRF410, SRF411, SRF414, SRF416, SRF536, SRF543, SRF529, SRF381, SRF388 and Ab7 antibodies (FIGS. 5F-5K, where: FIG. 5F shows inhibition of pSTAT1 signal in U937 (lymphoma) cells across increasing concentrations of anti-IL-27 antibodies; FIG. 5G shows inhibition of pSTAT1 signal in PBMCs (peripheral blood mononuclear cells) across increasing concentrations of anti-IL-27 antibodies; FIG. 5H shows varying effects upon CD161 signal in PBMCs (peripheral blood mononuclear cells) across increasing concentrations of anti-IL-27 antibodies; FIG. 5I shows varying effects upon PD-L1 signal in CD4 T lymphocytes (CD4 cells) across increasing concentrations of anti-IL-27 antibodies; FIG. 5J shows varying effects upon PD-L1 signal in monocytes across increasing concentrations of anti-IL-27 antibodies; and FIG. 5K shows inhibitory effects of varying degree upon TIM-3 signal in monocytes across increasing concentrations of anti-IL-27 antibodies).

Example 7: Inhibition of IL-27-Mediated Expression of PD-L1 and TIM3 by Anti-IL-27 Antibodies Anti-IL-27 antibodies described in Examples 1 and 2 were tested for their ability to inhibit IL-27-mediated expression PD-L1 and TIM-3 in pooled human monocytes by flow cytometry.

Fresh Monocytes were isolated from human buffy coats using RosetteSep™ Human Monocyte Enrichment Cocktail (Stemcell #15068).

Use of outer walls was avoided to minimize the effects of evaporation during the 5 day assay. Outer wells should be filled with 200 µL per well of DPBS (Gibco, 14190-144). Monocytes were resuspended at a density of 2 million cells per mL in warm, complete RPMI-1640. 100 µL per well of this cell mixture was plated (200,000 cells per well) in a round bottom 96-well plate (Costar, 3799).

Anti-IL-27 antibodies were diluted in complete RPMI-1640 in the first row of a 96-well polypropylene plate to a top concentration of 40 µg/ml (10 µg/ml final concentration). Serial dilutions as desired (1:2, 1:3, etc. . . . ) were made in the remainder of the first 10 rows of the plate. 50 µL of the antibody stock (4x) was added to the first 10 rows the plate of PBMC cells in the round bottom plate. In rows 11 and 12, 1250 µL of complete RPMI-1640 was added.

After the addition of the anti-IL-27 antibodies, 50 µL of 80 ng/ml recombinant human IL-27 (R&D Systems, 2526-IL) diluted in complete RPMI-1640 was added to each well (except, control wells which included serum-free media or antibody alone) for a final concentration of 20 ng/ml. 100 µL serum-free RPMI-1640 was added to control wells. The plate was incubated for 3 days at 37° C. with minimal interference.

After the 3-day incubation the plate was removed from the incubator and agitated on a plate shaker for 30 seconds at 600 RPM. The plate was centrifuged at 1800 RPM for 5 minutes. Media was discarded by flicking and plate was washed with 150 µL DPBS (Gibco, 14190-144). The washing steps were repeated twice. The cell pellets were stained with 50 µL per well of staining cocktail as described in the Table 9 below:

TABLE 9

| Biolegend Catalog # | Antibody Target | Color | Dilution |
|---|---|---|---|
| 345006 | TIM3 | PE | 1:100 |
| 301310 | CD11b | APC | 1:100 |
| 329714 | PD-L1 | BV421 | 1:100 |

The plate was agitated on a plate shaker for 30 seconds at 600 RPM and the plate was incubated for 30 minutes 4° C. in the dark.

After the 30-minute incubation, the plate was centrifuged and supernatant was discarded by flicking. The plate was washed 2 times as described previously. After the last wash cell pellets were fixed by adding 50 μL 4% PFA (Pierce, 28906) in deionized (DI) water at room temperature for 10 mins. 100 μL of FACS buffer was added to each well, and the plate was centrifuged at 1800 RPM for 5 minutes. Cells were resuspended in 100 μL FACS buffer and analyzed by flow cytometry.

Figure 6A:
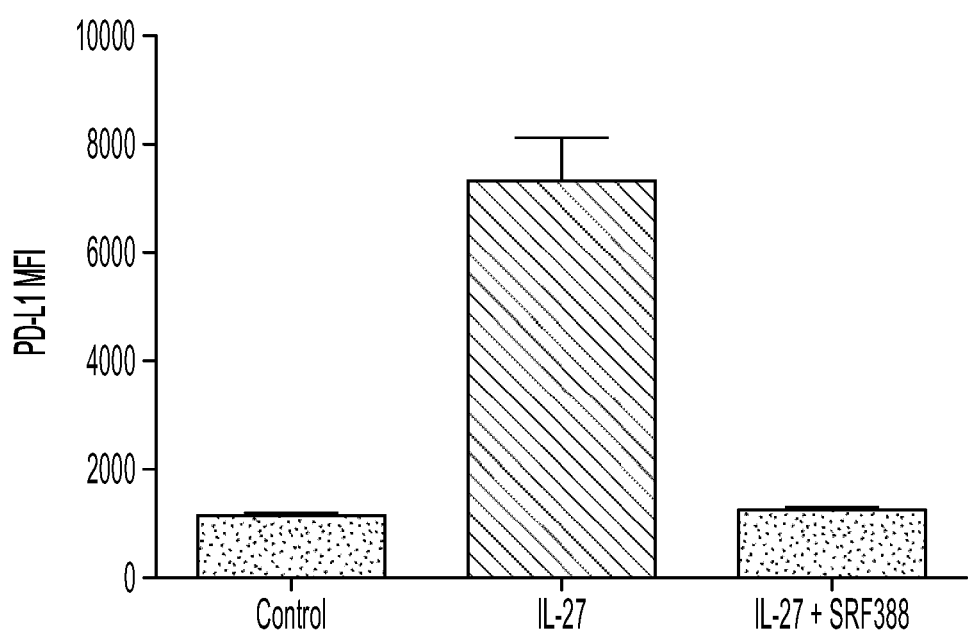
FIG. 6A is a graph depicting the inhibition of IL-27-mediated expression of PD-L1 by treatment of human monocytes with anti-IL-27 antibody as determined by flow cytometry.
Figure 6B:
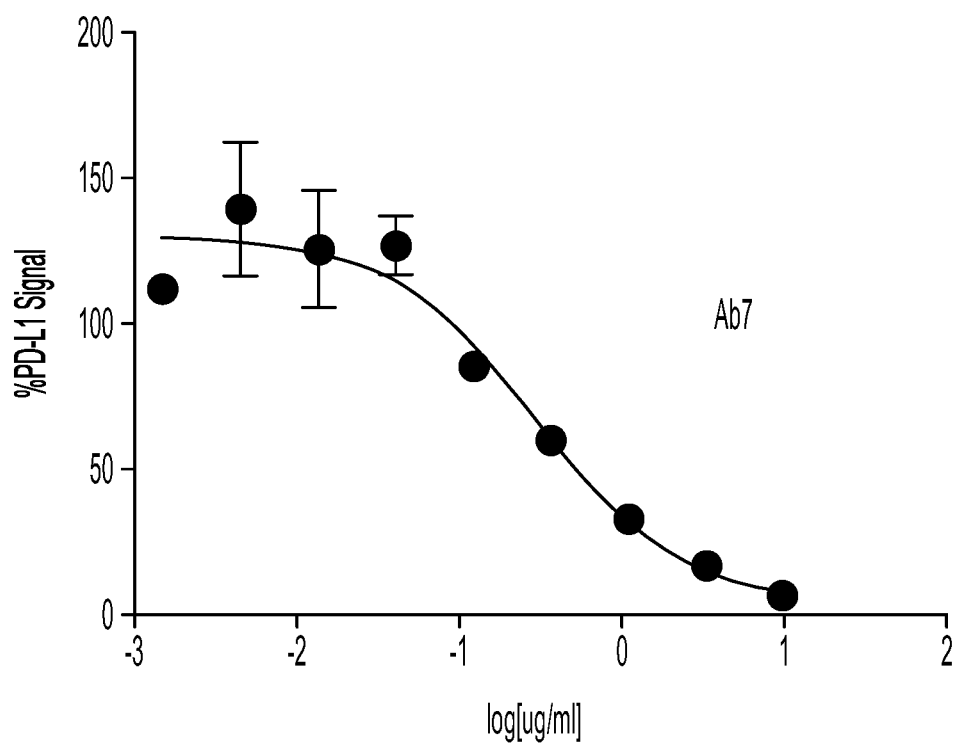
FIG. 6B is a graph depicting the dose-dependent inhibition of IL-27-mediated expression of PD-L1 by treatment of human monocytes with a range of concentrations of an anti-IL-27 antibody that specifically binds to the EBI3 monomer, as determined by flow cytometry.
Figure 6C:
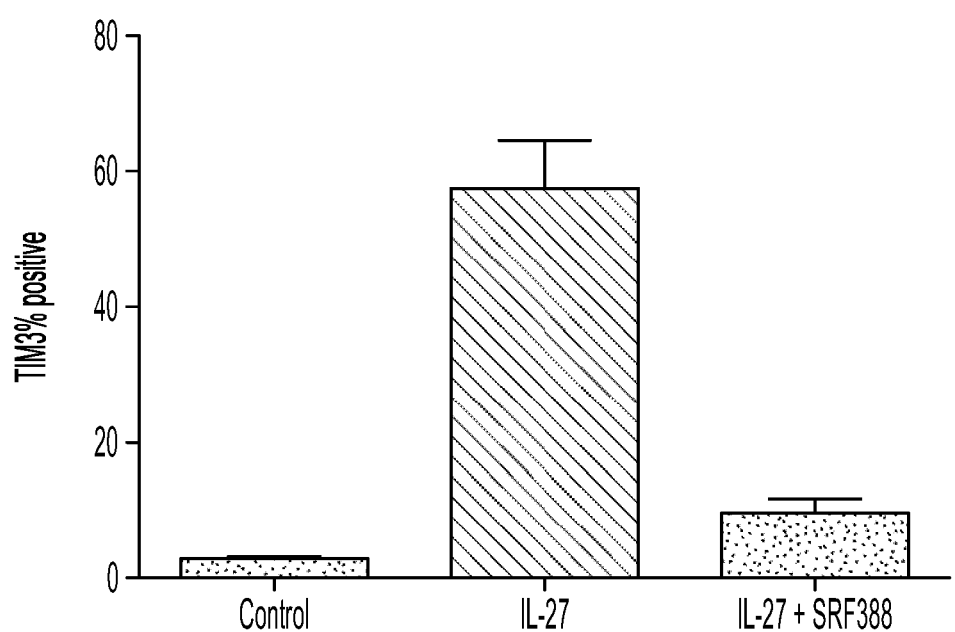
FIG. 6C is a graph depicting the inhibition of IL-27-mediated expression of TIM3 by treatment of human monocytes with anti-IL-27 antibody, as determined by flow cytometry.

As shown in FIGS. 6A, 6B and 6C, anti-IL-27 antibodies potently inhibit the IL-27 mediated expression of PD-L1 and TIM3 in pooled human monocytes.

Anti-IL-27 antibodies were further tested for their ability to inhibit IL-27-mediated expression of PD-L1 in resting T cells (inactivated) essentially as described for FIGS. 6A, 6B and 6C. Resting T-cells were isolated from human buffy coats using RosetteSep™ Human T cell Enrichment Cocktail (Stemcell #15061).

At the conclusion of the assay, the cell pellets were stained with 50 μL per well of staining cocktail as described in the Table 10 below:

TABLE 10

| Biolegend Catalog # | Antibody Target | Color | Dilution |
|---|---|---|---|
| 345006 | TIM3 | PE | 1:100 |
| 555349 | CD4 | APC | 1:100 |
| 329714 | PD-L1 | BV421 | 1:100 |
| 555366 | CD8 | FITC | 1:100 |

The plate was agitated on a plate shaker for 30 seconds at 600 RPM and the plate was incubated for 30 minutes at 4° C. in the dark.

Figure 6D:
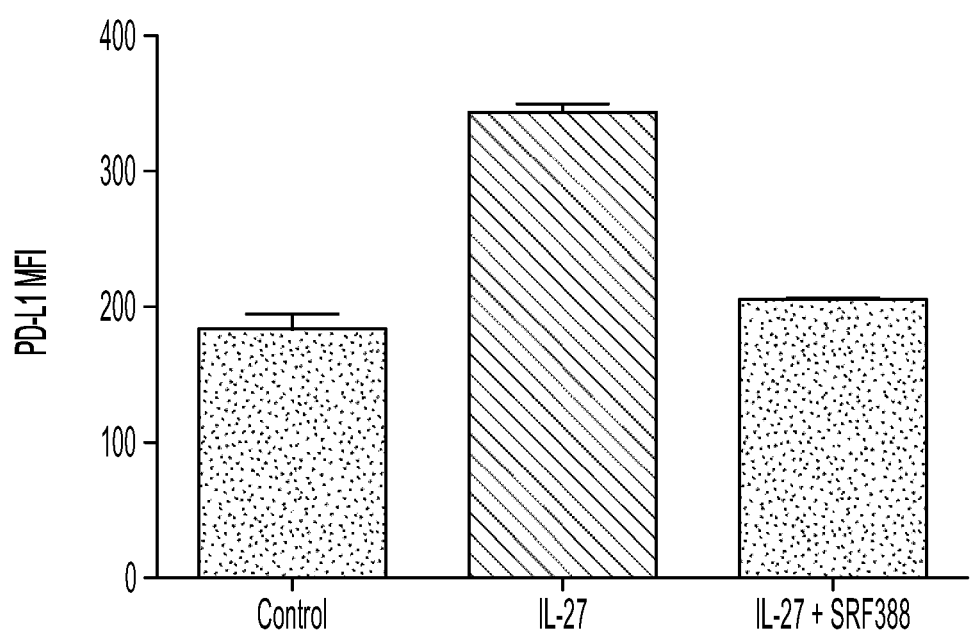
FIG. 6D is a graph depicting the inhibition of IL-27-mediated expression of PD-L1 by treatment of resting human T cells with anti-IL-27 antibody, as determined by flow cytometry.

After the 30-minute incubation, the plate was centrifuged and supernatant was discarded by flicking. The plate was washed 2 times as described previously. After the last wash cell pellets were fixed by adding 50 μL 4% PFA (Pierce, 28906) in DI water at room temperature for 10 mins. 100 μL of FACS buffer was added to each well, and the plate was centrifuged at 1800 RPM for 5 minutes. Cells were resuspended in 100 μL FACS buffer and read by flow cytometry. As shown in FIG. 6D, anti-IL-27 antibodies potently inhibit the IL-27-mediated expression of PD-L1 in pooled human resting T cells.

Example 8: In Vivo Efficacy of an Anti-IL-27 Antibody in a Disseminated B16F10 Model of Melanoma A model of melanoma lung metastasis was used to assess the antitumor activity of IL-27 blockade using the clinical candidate SRF388. The growth of disseminated B16F10 lung metastasis is known to be significantly reduced in EBI3 and Il27ra (Wsx-1)-deficient mice (Sauer et al., *J. Immunology* 181: 6148-6157). Since lung nodule size and growth kinetics are dependent on the number of B16F10 cells transferred and can proceed variably and rapidly, the combination of anti-PD-1 and anti-CTLA-4 was studied as a benchmark for therapeutic activity. SRF388 pre-treatment resulted in a significant reduction in overall tumor burden. To evaluate the anti-tumor efficacy of an anti-IL-27 antibody in vivo, the effect of Ab14 on tumor growth in a B16F10 melanoma tumor model was evaluated.

Briefly, six to eight-week-old female C57BL/6 mice (n=10/group) were inoculated intravenously (i.v.) with either $2.5 \times 10^5$ B16F10 cells or $1 \times 10^5$ B16-Luc cells via the tail vein in 2004, phosphate-buffered saline (PBS). Animals were injected intraperitoneally (i.p.) with SRF388 (1 mg dose) (Wuxi; lot 2108SD170316K01X01I01) or polyclonal human IgG isotype control (1 mg dose) (Bioxcell; BE0092; lot 658417D1). Antibodies were dosed once weekly beginning 7 days before tumor injection for a total of four doses (days −7, 0, 7, and 14). For visual enumeration of lung metastases, B16F10 tumor bearing mice were euthanized by $CO_2$ asphyxiation 18 days-post tumor cell injection and lungs were perfused with PBS via cardiac puncture, removed, and fixed in 10% neutral buffered formalin for 24 hours. Fixed lungs were then transferred to 70% ethanol and surface lung metastases were counted visually. For immunohistochemical analysis, formalin fixed lungs (n=5/group) were paraffin embedded, sectioned and stained with hematoxylin and eosin for quantification of total tumor area as a percentage of total tissue area in each section. For in vivo tumor imaging of lung metastases, B16-Luc tumor-bearing animals were injected i.v. via the tail vein with 3 mg of VivoGlo D-luciferin in 200 μl PBS (Promega) twice weekly. Five minutes after luciferin injection animals were anesthetized and bioluminescent imaging was performed using an IVIS Lumina LT Series III imager. Images were analyzed using Living Image (version 4.5.5) software and represented as total flux measurements in photons/second.

Figure 7A:
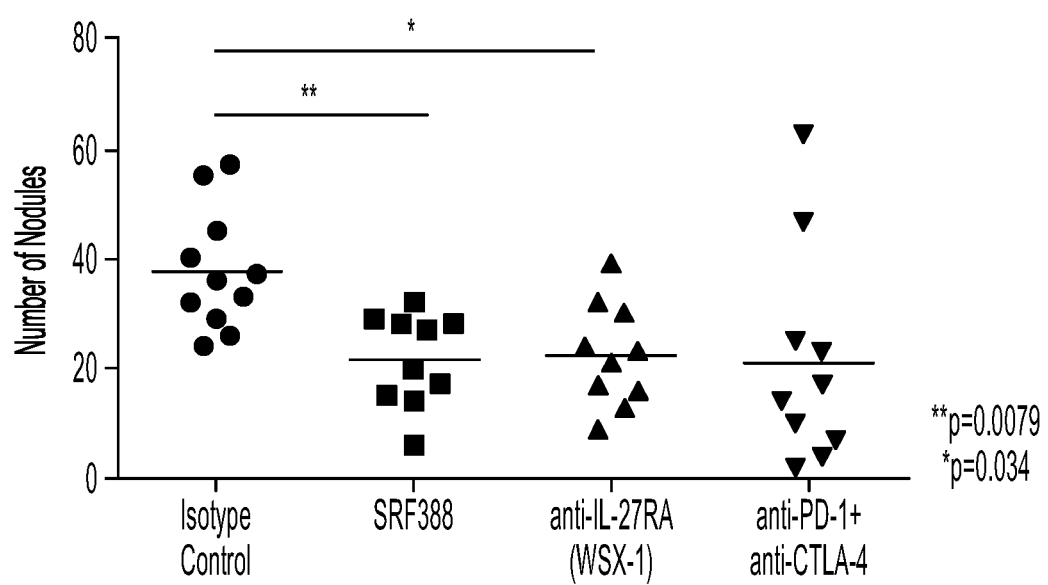
FIG. 7A is a dotplot depicting the number of surface lung B16F10 metastatic nodules (pulmonary nodules) from B16F10 tumor-bearing mice treated with anti-IL27 antibody (SRF388), isotype control antibody, αWSX-1 antibody or combined αPD-1 and αCTLA-4 antibodies, as indicated, as determined by visual counting of nodules from lungs isolated from mice.
Figure 7B:
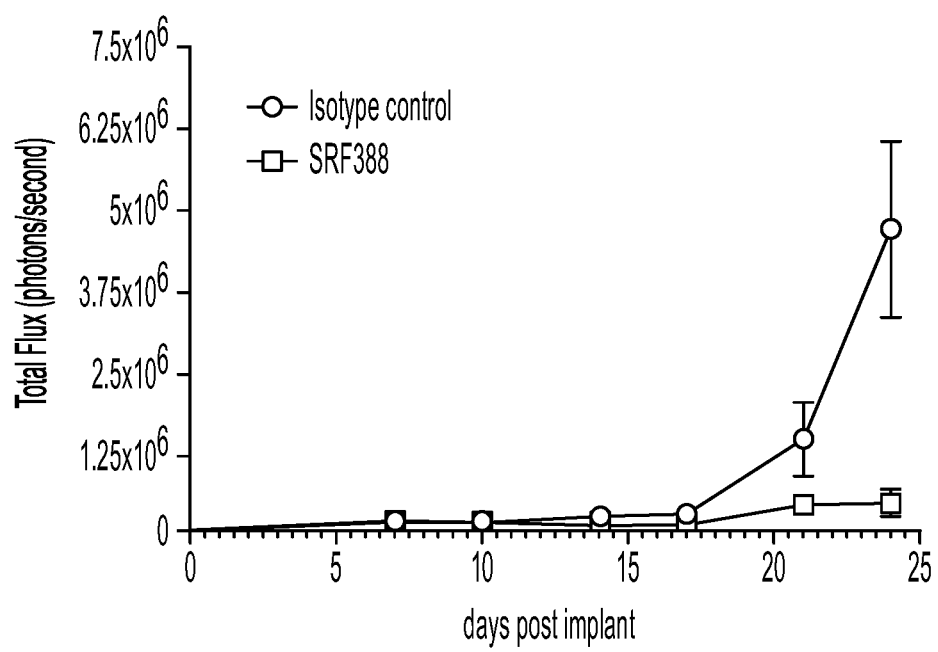
FIG. 7B provides a graph depicting the growth kinetics of bioluminescent B16-Luc tumors in mice treated with anti-IL-27 antibody (SRF388) or isotype control antibody, as determined by bioluminescent imaging analysis.
Figure 7C:
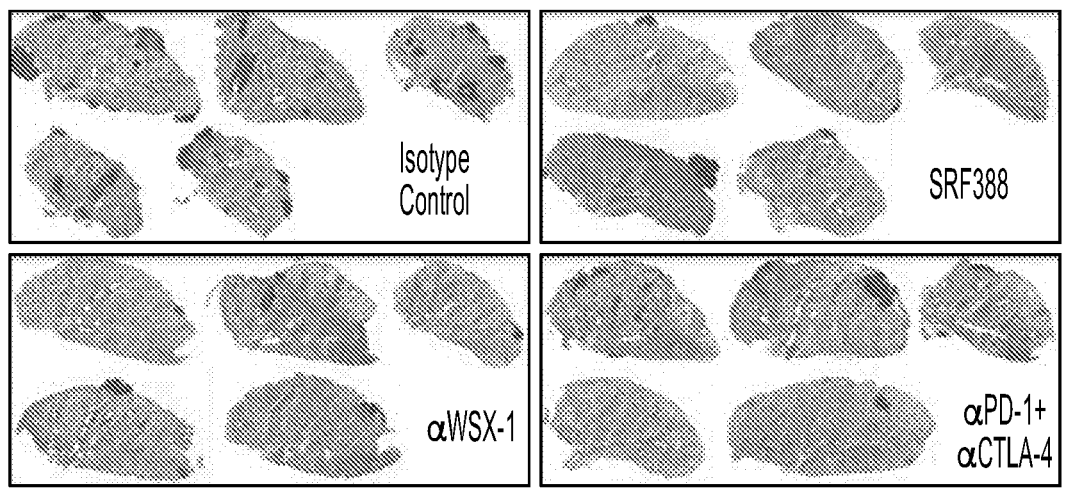
FIG. 7C shows a series of images of fixed, sectioned lung tissue stained with hematoxylin and eosin isolated from B16F10 tumor-bearing mice treated with anti-IL27 antibody (SRF388), isotype control antibody, αWSX-1 antibody or combined αPD-1 and αCTLA-4 antibodies, as indicated.
Figure 7D:
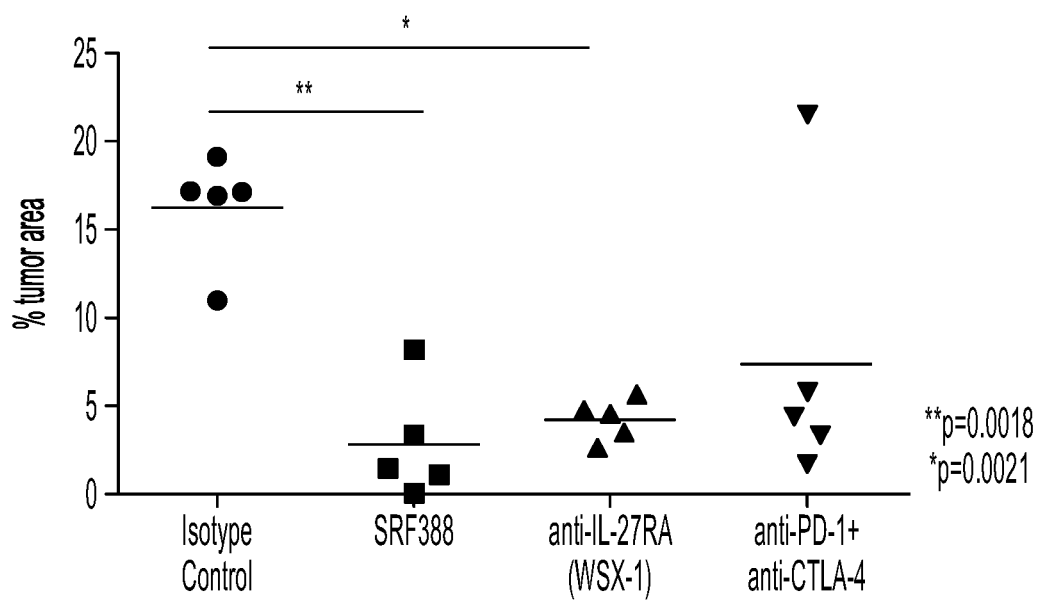
FIG. 7D is a dotplot depicting the total tumor area as a percentage of total tissue area of fixed, sectioned lung tissue B16F10 tumor tissue stained with hematoxylin and eosin isolated from B16F10 tumor-bearing mice treated with anti-IL27 antibody (SRF388), isotype control antibody, αWSX-1 antibody or combined αPD-1 and αCTLA-4 antibodies, as indicated, as determined by image analysis software. A similar reduction in surface lung metastasis number and total tumor area was observed with IL-27RA (WSX-1) mediated antibody blockade and with anti-PD-1+anti-CTLA-4 combination therapy.

As shown in FIGS. 7A-7D, treatment of B16F10 tumor-bearing mice with the anti-IL-27 antibody SRF388 resulted in a significant reduction in overall tumor burden as measured by both total counts of surface lung metastases (# pulmonary nodules, FIG. 7A), and by a reduction of tumor area in lung tissue sections by immunohistochemistry (IHC) analysis (FIG. 7C and FIG. 7D). Blockade of p28 with SRF388 resulted in a 42% reduction in the number of pulmonary B16 nodules compared to isotype control treatment. SRF388 treatment significantly inhibited (p=0.0079) the growth of B16F10 lung metastases compared to isotype control (21.6±8.4 versus 37.6±10.9 lung nodules, respectively). SRF388 treatment resulted in an 83% reduction in overall lung tumor metastasis area as measured by IHC (16.43±1.39% in the isotype control group versus 2.83±1.45% in the SRF388 treatment group). Similarly, bioluminescent imaging revealed that SRF388 treatment significantly (p=0.0062) delayed the growth of B16-Luc lung metastases (FIG. 7B). A similar reduction in surface lung metastasis number and total tumor area was observed with IL-27RA (WSX-1) mediated antibody blockade and with anti-PD-1+anti-CTLA-4 combination therapy, as shown in FIG. 7D. These data are from 2 independent experiments in which anti-PD-1 and anti-CTLA-4 benchmark combination demonstrated antitumor activity. B16F10 cells ($2.5 \times 10^5$) were injected intravenously in C57BL/6 mice (n=10/group). Mice were treated IP with 1 mg of either SRF388, anti-IL-27RA (WSX-1), or human IgG isotype control antibody (Days −7, 0, 7, 14). Some animals were treated IP with anti-PD-1 and anti-CTLA-4 (Days 0, 4, 7, and 11). Lungs were collected from animals (n=5/group)

bearing B16F10 lung metastases treated as described above were sectioned and stained with H&E. B16F10 tumor tissue was delineated from normal lung tissue in H&E stained lung sections from treated animals (FIG. 7A). Tumor area was calculated as a percentage of total lung area (FIG. 7D). Statistics were calculated by t-test. Collectively, these data indicate that SRF388 can phenocopy Il27ra (WSX-1) and EBI3 deficiency in a tumor model and shows similar activity to combined blockade of PD-1 and CTLA-4.

These data demonstrate that treatment with an anti-IL-27 antibody (SRF388) results in anti-tumor effects, reducing both tumor growth and metastasis to a greater extent that treatment with an isotype control antibody that does not bind IL-27.

Figure 8A:
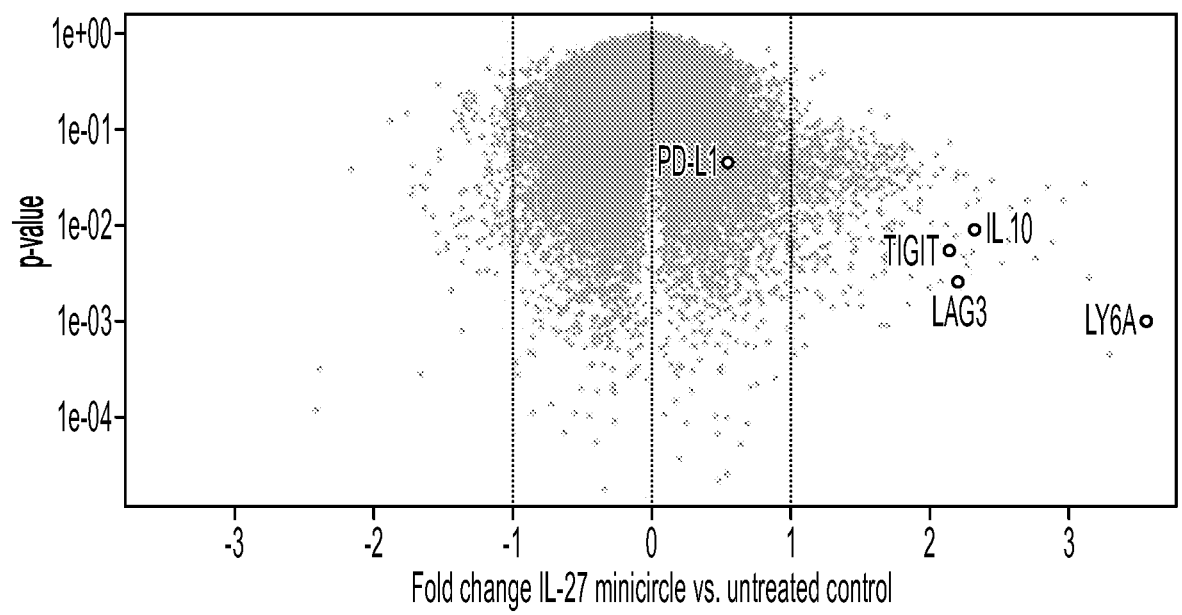
FIG. 8A provides a scatterplot depicting microarray data of genes with an expression change >1.0 log 2 fold change (black dots) in splenocytes isolated from mice overexpressing IL-27 following treatment with IL-27 minicircles.
Figure 8B:
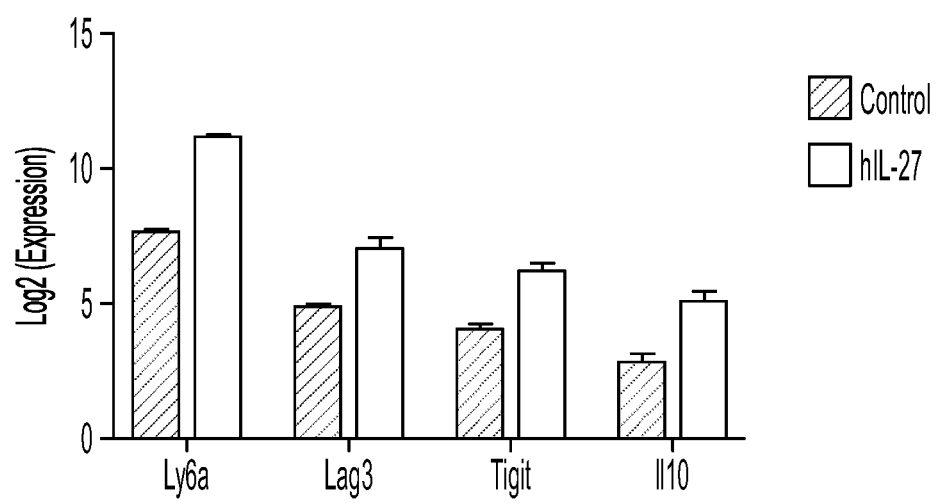
FIG. 8B provides a graph depicting the expression level of select immunomodulatory genes, as indicated, in splenocytes as in FIG. 8A.
Figure 8C:
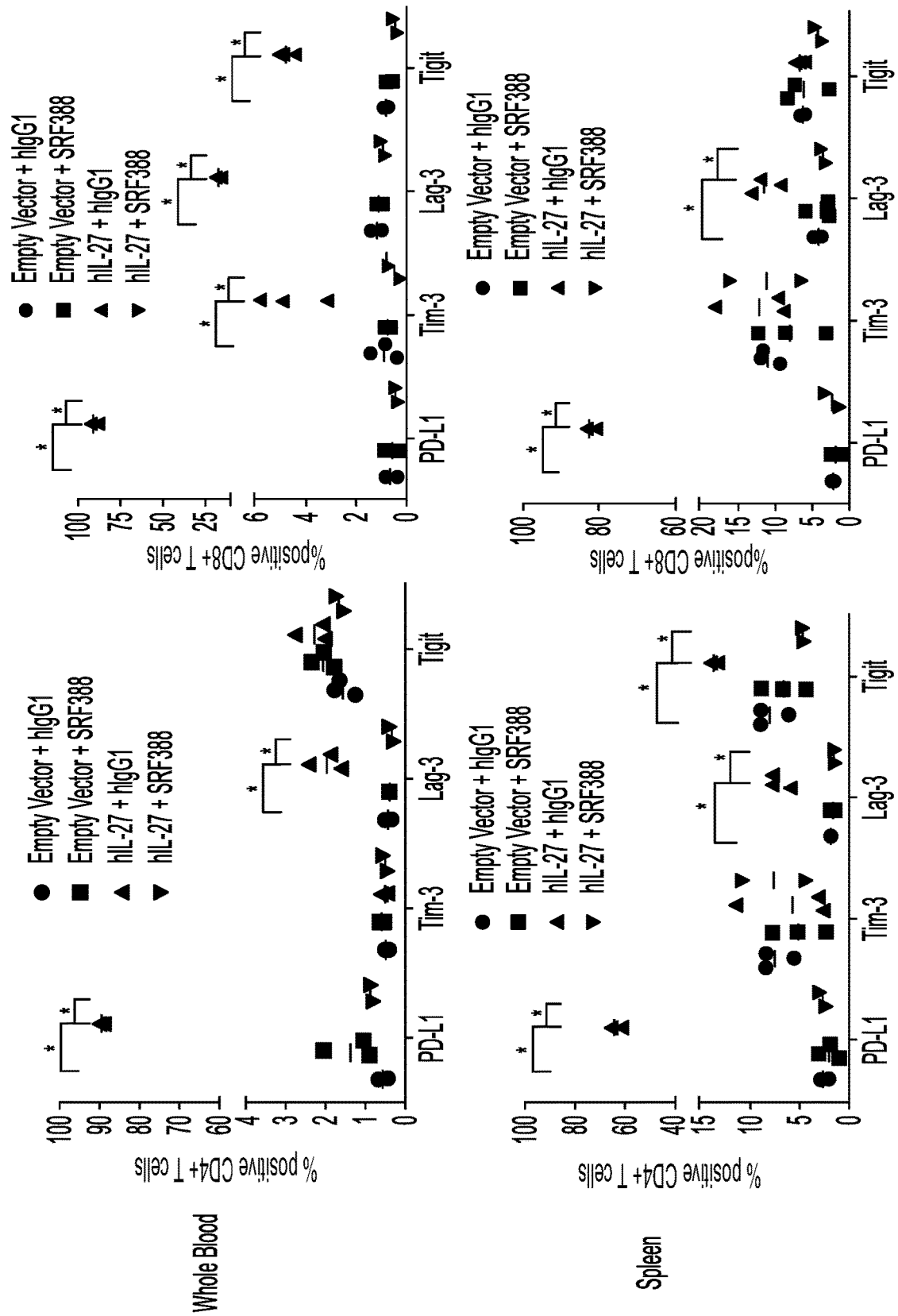
FIG. 8C shows ectopic expression of human IL-27 induces inhibitory receptor expression on murine T cells in vivo and that SRF388 reduces inhibitory receptor expression on T cells in vivo after IL-27 minicircle treatment. Six-week-old female Balb/c mice were injected with empty vector (control) or hIL-27 minicircle. (top left and right panels) PBMCs and (bottom left and right panels) total splenocytes were collected 5 days after transfection and cells were stained and analyzed by flow cytometry. Expression of the indicated markers were analyzed on CD4+ T cells (top left and bottom left panels) and CD8+ T cells (top right and bottom right panels). Analysis was performed using FlowJo software.

Example 9: Gene Expression Profiling of Murine Splenocytes from Mice Hydrodynamically Transfected with Human IL-27 Minicircles To examine the effect of IL-27 on T cell phenotype in vivo, DNA minicircles encoding IL-27 were used to overexpress IL-27 in mice and T cell responses were assessed by RNA-Seq and flow cytometry. Human IL-27 is known to be species cross-reactive and can induce pSTAT1 signaling and PD L1 in murine splenocytes in vitro. This species cross-reactivity was used to study the effects of human IL-27 overexpression in mice and its inhibition by SRF388. To do this, DNA plasmid minicircles encoding human IL-27 (p28 tethered to EBI3 by a glycine serine linker) were administered to mice by hydrodynamic transfection, as described below, which resulted in high systemic levels of IL-27.
Hydrodynamic Transfection of Human IL-27 Minicircles Six-week-old female BALB/c mice were injected with 20 µg of either empty vector or linked human IL-27 minicircle DNA (System Biosciences, Palo Alto, CA) in 2 mL 0.9% normal saline via the tail vein over the course of 5 seconds. Injected animals were transferred to an empty cage with a heating pad to recover for 5 minutes. Whole blood was collected into K2-EDTA tubes for plasma separation 24 hours after minicircle injection and plasma IL-27 levels were confirmed by ELISA. PBMCs and total splenocytes were collected 5 days after transfection and cells were stained and analyzed by flow cytometry. Expression of the indicated markers were analyzed on CD4+ T cells and CD8+ T cells. Analysis was performed using FlowJo software.
Gene Expression Profiling Mouse splenocytes were prepared by mechanical dissociation of whole spleens, followed by ACK lysis of red blood cells. Total RNA was extracted from splenocytes with the RNeasy® Mini Kit (Qiagen, Cat. No: 74104) and adjusted to 20 ng/ul in nuclease free water (Qiagen, Cat. No: 19101). Gene expression profiling on was performed on Affymetrix GeneChip™ Mouse Gene 2.0 ST Arrays (Applied Biosystems, Cat. No: 902118). Processing of RNA samples, hybridization and array scanning were carried out using standard Affymetrix GeneChip™ protocols at the Boston University Microarray and Sequencing Resource (BUMSR). All CEL files were normalized by Robust Multi-array Average (RMA) (Irizarry et al., 2003) and gene expression data were preprocessed by removing unexpressed probes and discarding transcripts with high inter-replicate coefficient of variance. Subsequent analyses (mean expression, fold change, t test) were performed in R.
Flow Cytometric Analysis Whole blood and spleens were collected from mice five days after minicircle injection. Splenocytes were collected from IL 27-expressing mice 5 days after transfection and analyzed by Affymetrix GeneChip Mouse Gene 2.0 ST Array. Single cell splenocyte suspensions were prepared by mechanical dissociation through a 40 µm nylon cell strainer followed by red blood cell lysis in ACK buffer. Whole blood cells were stained directly followed by red blood cell lysis and fixation in BD Phosflow Lyse/Fix Buffer according to the manufacturer's instructions (BD Biosciences, San Jose, CA). FcγRIII/II was blocked by preincubating cells with rat anti-mouse CD16/CD32 mAb (1 µg per million cells; Biolegend, San Diego, CA) in PBS with 2% FBS and 2 mM EDTA. Cells were stained with APC-, PE-, Brilliant Violet 510-, and Brilliant Violet 711-conjugated mAbs against murine CD4 (clone GK1.5), CD8 (53-6.7), PD-L1 (10F.9G2), TIM3 (RMT3-23), LAG3 (C9B7W), and TIGIT (1G9) (Biolegend). Cell-associated fluorescence was measured using an LSRFortessa X-20 flow cytometer (BD Biosciences), and analysis was performed using FlowJo software (Tree Star, Ashland, OR).
Statistical Analysis Statistical significance was determined using GraphPad Prism software, using a paired, unpaired, or ratio Student's t test, as indicated. When the ratio t test was used, 0.1 was added to zero values to make them non-zero. P values less than 0.05 were considered significant.
IL-27 Promotes Expression of Inhibitory Receptors by T Cells In Vivo Over 400 genes were changed by >1.0 fold in response to administration of IL-27, as shown in FIG. 8A. A subset of these genes is shown in Table 11. Among these genes were those that encode immune inhibitory receptors that play key roles in the immune response. As shown in FIG. 8B, Ly6a (encodes Sca-1), Lag3, Tigit and Il10 were upregulated on splenocytes in response to IL-27. There was also a trend toward IL-27-mediated upregulation of Ctla4 and Cd274 (encodes PD-L1) that was less than 1-fold induction (data not shown). To validate the expression data, flow cytometry was utilized to assess the protein expression of PD-L1, LAG-3, TIGIT and TIM-3 on T cells from these mice. Administration of IL-27 minicircles led to upregulation of PD-L1, LAG-3 and TIGIT in splenic (Spleen) and peripheral blood (PBMC) CD4+ T cells. In CD8+ T cells, IL-27 minicircles upregulated PD-L1, LAG-3, TIGIT, and TIM-3. As shown in FIG. 8C, administration of IL-27 minicircles led to upregulation of PD-L1, Lag-3, and Tigit in splenic and peripheral blood CD4+ T cells. In CD8+ T cells, IL-27 minicircles upregulated PD-L1, Lag-3, Tigit, and Tim-3. These data suggest that IL-27 can play a key role in driving immunoregulatory receptor expression in vivo.

To investigate the ability of SRF388 to block minicircle-derived human IL-27 in vivo, both target engagement by enzyme-linked immunosorbent assay (ELISA) and immunoregulatory receptor expression in splenocytes were studied. Five days after IL-27 transfection and treatment with SRF388 (50 mg/kg), plasma was collected from mice to analyze IL-27 heterodimer and EBI3 levels by Meso Scale Discovery (MSD). The IL-27 heterodimer assay utilizes a p28 capture antibody that cross blocks SRF388 and a human specific EBI3 detection antibody; therefore, if SRF388 is bound to IL-27 then its detection will be masked. The EBI3 assay utilizes both capture and detection antibodies specific for 2 distinct epitopes of human EBI3 and since the minicircle derived IL-27 is a tethered heterodimer this assay allows for detection of total IL 27 irrespective of SRF388 binding.

Figure 8D:
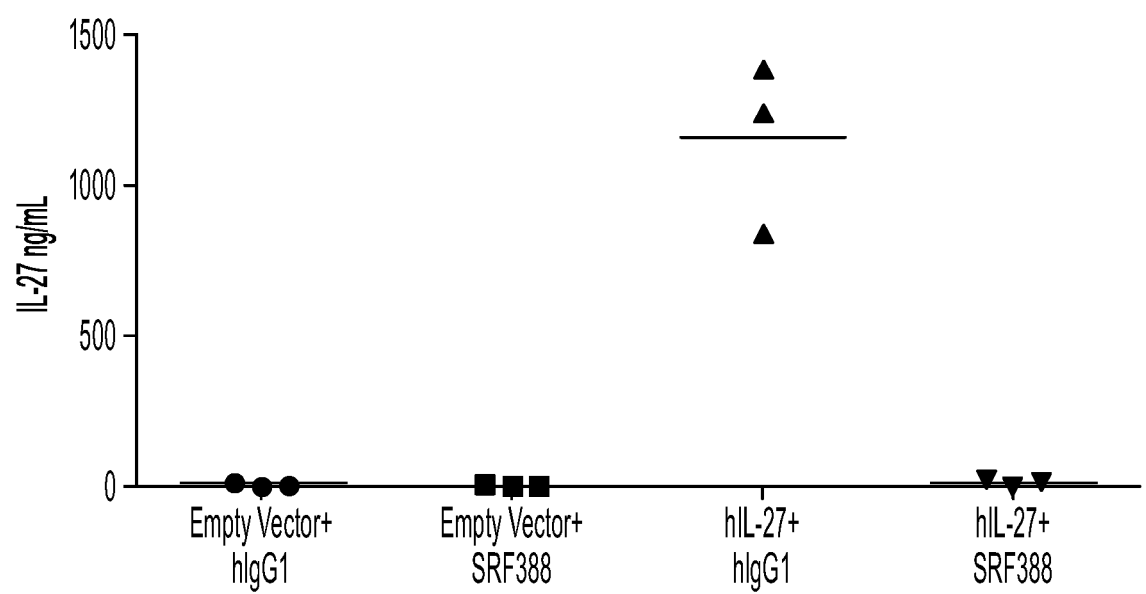
FIG. 8D shows that SRF388 inhibits detection of minicircle-derived human IL-27 in murine plasma.

Briefly, Six-week-old female Balb/c mice were injected with empty vector (control) or human IL-27. Mice were treated with 1 mg of either SRF388 or anti-DNP IgG1 isotype control antibody 7 days before and on the day of minicircle transfection (Day −7 and 0). Whole blood was collected, and plasma was analyzed for IL-27 (FIG. 8D) by Meso Scale Discovery. FIG. 8D shows that SRF388 treatment completely inhibits IL-27 detection in plasma by MSD. Similar data were seen when a dose of 25 mg/kg of SRF388 was tested. These data suggest that SRF388 at a dose of 25 mg/kg or higher can completely saturate minicircle derived IL-27 in vivo. This complete target engagement was also confirmed in a pSTAT1 functional assay.

To assess the ability of SRF388 to block the activity of IL-27 in vivo, the expression of PD L1, Tim-3, Lag-3, and Tigit were analyzed in murine PBMCs and splenocytes by flow cytometry. SRF388 significantly blocked IL 27-induced PD-L1 and Lag 3 expression in CD4+ PBMCs and PD-L1, Tim-3, Lag-3, and Tigit expression in CD8+ PBMCs. SRF388 treatment also blocked IL 27 induced PD-L1, Lag-3, and Tigit expression in CD4+ splenocytes and PD-L1 and Lag 3 expression in CD8+ splenocytes. These data suggest that SRF388 can both engage and block the activity of human IL-27 in vivo.

These results demonstrate that ectopic expression of IL-27 in vivo leads to upregulation of multiple inhibitory receptors by T cells, and several other molecules with immunomodulatory activity in splenocytes. These data suggest that IL-27 antagonism (e.g., by treatment with an anti-IL-27 antibody) would decrease the expression of inhibitor receptors on T cells, thereby increasing immune responses.

TABLE 11

Genes Upregulated in Response to Administration of IL-27

| Gene Symbol | Fold Change | p value |
|---|---|---|
| GM4841 | 3.824228667 | 0.012331653 |
| LY6A | 3.568709 | 0.000991642 |
| IIGP1 | 3.294783 | 0.000455248 |
| TUBB1 | 3.145617 | 0.002782618 |
| MPO | 3.112051333 | 0.026667968 |
| CTSG | 2.954178333 | 0.018177934 |
| PPBP | 2.878417333 | 0.006623845 |
| ELANE | 2.845762333 | 0.024770656 |
| MT2 | 2.757525667 | 0.004548988 |
| MUC13 | 2.696042667 | 0.018195326 |
| F830016B08RIK | 2.603319667 | 0.011330985 |
| GM4951 | 2.583066667 | 0.01529863 |
| APOL11B | 2.565688667 | 0.006885943 |
| GZMB | 2.515642667 | 0.004012308 |
| PRTN3 | 2.450033 | 0.028785527 |
| CLCA3A1 | 2.345778333 | 0.018175529 |
| GM11505 | 2.331628667 | 0.023451392 |
| IL10 | 2.324278 | 0.008857442 |
| GBP11 | 2.307386 | 0.005204674 |
| PF4 | 2.270045 | 0.016210658 |
| IRG1 | 2.269440667 | 0.003861367 |
| CES2G | 2.252403333 | 0.033921335 |
| OASL2 | 2.243393 | 0.00470682 |
| LAG3 | 2.203067 | 0.002539095 |
| HIST1H2AG | 2.197938 | 0.03499933 |
| OAS1G | 2.184084667 | 0.007645573 |
| MFSD2B | 2.179382333 | 0.030664254 |
| RHAG | 2.146212667 | 0.072130267 |
| TIGIT | 2.145155 | 0.005421349 |
| SLC6A4 | 2.121439 | 0.009945773 |
| SHCBP1 | 2.092208667 | 0.038685767 |
| BC023105 | 2.079652 | 0.002582842 |
| PKLR | 2.045597333 | 0.053459171 |
| TFR2 | 2.037887333 | 0.033394313 |
| F13A1 | 2.010803333 | 0.010612157 |
| HIST1H2AB | 2.002687333 | 0.025241 |
| SERPINA3F | 1.991916 | 0.002220854 |
| ERMAP | 1.940590333 | 0.042680673 |

TABLE 11-continued

Genes Upregulated in Response to Administration of IL-27

| Gene Symbol | Fold Change | p value |
|---|---|---|
| MCPT8 | 1.930212667 | 0.018921256 |
| SLC26A1 | 1.926420667 | 0.025126602 |
| PRKAR2B | 1.924056667 | 0.016881189 |
| BIRC5 | 1.914826333 | 0.032959509 |
| FADS2 | 1.91223 | 0.013830993 |
| TOP2A | 1.88339 | 0.034852729 |
| NCAPG | 1.881082333 | 0.036612626 |
| A730089K16RIK | 1.870258667 | 0.061491704 |
| MNS1 | 1.860366 | 0.014834618 |
| GP9 | 1.859234333 | 0.002956835 |
| GFI1B | 1.852962 | 0.0291761 |
| NUF2 | 1.850953 | 0.032872517 |
| CHIL3 | 1.848470667 | 0.001494932 |
| KIF11 | 1.83252 | 0.040535377 |
| ALOX12 | 1.823174 | 0.006931665 |
| ADGRG7 | 1.822065 | 0.017542834 |
| KLF1 | 1.820262333 | 0.060689421 |
| E2F8 | 1.817455333 | 0.069143254 |
| ATP1B2 | 1.811274333 | 0.024016123 |
| KIF2C | 1.811223333 | 0.061246458 |
| FADS3 | 1.803859667 | 0.050197663 |
| MS4A6D | 1.801871667 | 0.01036878 |
| SLC25A21 | 1.801518667 | 0.048282826 |
| HIST1H1B | 1.800434 | 0.037242995 |
| CKAP2L | 1.783850333 | 0.061646634 |
| SAMD14 | 1.782388333 | 0.02384128 |
| CAR1 | 1.770098667 | 0.025511071 |
| DEPDC1A | 1.765839667 | 0.03875749 |
| CENPE | 1.765095667 | 0.039288425 |
| ASPM | 1.753558 | 0.054145246 |
| CCNB2 | 1.751291667 | 0.036336189 |
| RYK | 1.749673 | 0.035413093 |
| MMP14 | 1.747348667 | 0.010510984 |
| BUB1 | 1.738322667 | 0.02139336 |
| MYO1D | 1.734508 | 0.006655486 |
| PARVB | 1.733820333 | 0.010799396 |
| GM5593 | 1.728317 | 0.008578526 |
| CCNA2 | 1.724975667 | 0.026630845 |
| PRR1 | 1.724352667 | 0.04875805 |
| AQP1 | 1.719081667 | 0.064562051 |
| CASP3 | 1.709594333 | 0.009087444 |
| KIF15 | 1.708689667 | 0.026782535 |
| ASNS | 1.708074333 | 0.037928738 |
| CPOX | 1.706113 | 0.030298001 |
| MT1 | 1.699002667 | 0.010159345 |
| CDC6 | 1.694586667 | 0.049970924 |
| GBP2B | 1.694018 | 0.000929009 |
| GBP2 | 1.689558667 | 0.004961011 |
| HMMR | 1.687253333 | 0.063769534 |
| KIF20A | 1.686718333 | 0.020639142 |
| GSTM5 | 1.681807333 | 0.04316743 |
| REEP6 | 1.677204667 | 0.056071877 |
| GM12250 | 1.675485 | 0.003251181 |
| GBP10 | 1.673458 | 0.009333312 |
| ATP7B | 1.671614 | 0.029798535 |
| GM22973 | 1.663495667 | 0.004472758 |
| CASC5 | 1.659578 | 0.044333895 |
| ADD2 | 1.659553667 | 0.053938067 |
| CAMP | 1.659111667 | 0.066745225 |
| CLEC5A | 1.654882667 | 0.00665055 |

TABLE 12

| SEQUENCE LISTING | | |
|---|---|---|
| SEQ ID NO | Description | Sequence |
| | | SRF529-A |
| 51 | HCDR1 (IMGT) | GFTFSSYS |
| 52 | HCDR2 (IMGT) | ISSSSSYI |
| 53 | HCDR3 (IMGT) | ARDGGRTSYTATAHNWFDP |
| 54 | HCDR1 (NT) | FTFSSYSMN |
| 55 | HCDR2 (NT) | SISSSSSYIYYADSVKG |
| 56 | HCDR3 (NT) | ARDGGRTSYTATAHNWFDP |
| 57 | VH | EVQLVESGGGLVKPGGSLRLSCAASGFTFSSYSMNWVRQAPGKG LEWVSSISSSSSYIYYADSVKGRFTISRDNAKNSLYLQMNSLRA EDTAVYYCARDGGRTSYTATAHNWFDPWGQGTLVTVSS |
| 58 | DNA VH | GAGGTGCAGCTGGTGGAGTCTGGGGGAGGCCTGGTCAAGCCTGG GGGGTCCCTGAGACTCTCCTGTGCAGCCTCTGGATTCACCTTCA GTAGCTATAGCATGAACTGGGTCCGCCAGGCTCCAGGGAAGGGG CTGGAGTGGGTCTCATCCATTAGTAGTAGTAGTAGTTACATATA CTACGCAGACTCAGTGAAGGGCCGATTCACCATCTCCAGAGACA ACGCCAAGAACTCACTGTATCTGCAAATGAACAGCCTGAGAGCC GAGGACACGGCGGTGTACTACTGCGCCAGAGATGGTGGAAGAAC GTCCTACACCGCCACAGCCCACAATTGGTTCGACCCCTGGGGAC AGGGTACATTGGTCACCGTCTCCTCA |
| 59 | LCDR1 (IMGT) | QSVLFSSNNKNY |
| 60 | LCDR2 (IMGT) | WAS |
| 61 | LCDR3 (IMGT) | QQHASAPPT |
| 62 | LCDR1 (NT) | KSSQSVLFSSNNKNYLA |
| 63 | LCDR2 (NT) | WASTRES |
| 64 | LCDR3 (NT) | QQHASAPPT |
| 65 | VL | DIVMTQSPDSLAVSLGERATINCKSSQSVLFSSNNKNYLAWYQQ KPGQPPKLLIYWASTRESGVPDRFSGSGSGTDFTLTISSLQAED VAVYYCQQHASAPPTFGGGTKVEIK |
| 66 | DNA VL | GACATCGTGATGACCCAGTCTCCAGACTCCCTGGCTGTGTCTCT GGGCGAGAGGGCCACCATCAACTGCAAGTCCAGCCAGAGTGTTT TATTCAGCTCCAACAATAAGAACTACTTAGCTTGGTACCAGCAG AAACCAGGACAGCCTCCTAAGCTGCTCATTTACTGGGCATCTAC CCGGGGAATCCGGGGTCCCTGACCGATTCAGTGGCAGCGGGTCTG GGACAGATTTCACTCTCACCATCAGCAGCCTGCAGGCTGAAGAT GTGGCAGTTTATTACTGTCAGCAGCACGCCAGTGCCCCTCCTAC TTTTGGCGGAGGGACCAAGGTTGAGATCAAA |
| 67 | Heavy Chain | EVQLVESGGGLVKPGGSLRLSCAASGFTFSSYSMNWVRQAPGKG LEWVSSISSSSSYIYYADSVKGRFTISRDNAKNSLYLQMNSLRA EDTAVYYCARDGGRTSYTATAHNWFDPWGQGTLVTVSSASTKGP SVFPLAPSSKSTSGGTAALGCLVKDYFPEPVTVSWNSGALTSGV HTFPAVLQSSGLYSLSSVVTVPSSSLGTQTYICNVNHKPSNTKV DKKVEPKSCDKTHTCPPCPAPELLGGPSVFLFPPKPKDTLMISR TPEVTCVVVDVSHEDPEVKFNWYVDGVEVHNAKTKPREEQYNST YRVVSVLTVLHQDWLNGKEYKCKVSNKALPAPIEKTISKAKGQP REPQVYTLPPSRDELTKNQVSLTCLVKGFYPSDIAVEWESNGQP ENNYKTTPPVLDSDGSFFLYSKLTVDKSRWQQGNVFSCSVMHEA LHNHYTQKSLSLSPGK |
| 68 | DNA Heavy Chain | GAGGTGCAGCTGGTGGAGTCTGGGGGAGGCCTGGTCAAGCCTGG GGGGTCCCTGAGACTCTCCTGTGCAGCCTCTGGATTCACCTTCA GTAGCTATAGCATGAACTGGGTCCGCCAGGCTCCAGGGAAGGGG CTGGAGTGGGTCTCATCCATTAGTAGTAGTAGTAGTTACATATA CTACGCAGACTCAGTGAAGGGCCGATTCACCATCTCCAGAGACA ACGCCAAGAACTCACTGTATCTGCAAATGAACAGCCTGAGAGCC GAGGACACGGCGGTGTACTACTGCGCCAGAGATGGTGGAAGAAC GTCCTACACCGCCACAGCCCACAATTGGTTCGACCCCTGGGGAC AGGGTACATTGGTCACCGTCTCCTCAGCGAGCACCAAAGGCCCG AGCGTGTTTCCGCTGGCGCCAGCAGCAAAAGCACCAGCGGCGG CACCGCGGCGCTGGGCTGCCTGGTGAAAGATTATTTTCCGGAAC CGGTGACCGTGAGCTGGAACAGCGGCGCGCTGACCAGCGGCGTG CATACCTTTCCGGCGGTGCTGCAGAGCAGCGGCCTGTATAGCCT GAGCAGCGTGGTGACCGTGCCGAGCAGCAGCCTGGGCACCCAGA CCTATATTTGCAACGTGAACCATAAACCGAGCAACACCAAAGTG GATAAAAAAGTGGAACCGAAAAGCTGCGATAAAACCCATACCTG CCCGCCGTGCCCGGCGCCGGAACTGCTGGGCGGCCCGAGCGTGT TTCTGTTTCCGCCGAAACCGAAAGATACCCTGATGATTAGCCGC ACCCCGGAAGTGACCTGCGTGGTGGTGGATGTGAGCCATGAAGA TCCGGAAGTGAAATTTAACTGGTATGTGGATGGCGTGGAAGTGC ATAACGCGAAAACCAAACCGCGCGAAGAACAGTATAACAGCACC |

TABLE 12-continued

SEQUENCE LISTING

| SEQ ID NO | Description | Sequence |
|---|---|---|
| | | TATCGCGTGGTGAGCGTGCTGACCGTGCTGCATCAGGATTGGCT<br>GAACGGCAAAGAATATAAATGCAAAGTGAGCAACAAAGCGCTGC<br>CGGCCGCCGATTGAAAAAACCATTAGCAAAGCGAAAGGCCAGCCG<br>CGCGAACCGCAGGTGTATACCCTGCCGCCGAGCCGCGATGAACT<br>GACCAAAAACCAGGTGAGCCTGACCTGCCTGGTGAAAGGCTTTT<br>ATCCGAGCGATATTGCGGTGGAATGGGAAAGCAACGGCCAGCCG<br>GAAAACAACTATAAAACCACCCCGCCGGTGCTGGATAGCGATGG<br>CAGCTTTTTTCTGTATAGCAAACTGACCGTGGATAAAAGCCGCT<br>GGCAGCAGGGCAACGTGTTTAGCTGCAGCGTGATGCATGAAGCG<br>CTGCATAACCATTATACCCAGAAAAGCCTGAGCCTGAGCCCGGG<br>CAAA |
| 69 | Light Chain | DIVMTQSPDSLAVSLGERATINCKSSQSVLFSSNNKNYLAWYQQ<br>KPGQPPKLLIYWASTRESGVPDRFSGSGSGTDFTLTISSLQAED<br>VAVYYCQQHASAPPTFGGGTKVEIKRTVAAPSVFIFPPSDEQLK<br>SGTASVVCLLNNFYPREAKVQWKVDNALQSGNSQESVTEQDSKD<br>STYSLSSTLTLSKADYEKHKVYACEVTHQGLSSPVTKSFNRGEC |
| 70 | DNA Light Chain | GACATCGTGATGACCCAGTCTCCAGACTCCCTGGCTGTGTCTCT<br>GGGCGAGAGGGCCACCATCAACTGCAAGTCCAGCCAGAGTGTTT<br>TATTCAGCTCCAACAATAAGAACTACTTAGCTTGGTACCAGCAG<br>AAACCAGGACAGCCTCCTAAGCTGCTCATTTACTGGGCATCTAC<br>CCGGGAATCCGGGGTCCCTGACCGATTCAGTGGCAGCGGGTCTG<br>GGACAGATTTCACTCTCACCATCAGCAGCCTGCAGGCTGAAGAT<br>GTGGCAGTTTATTACTGTCAGCAGCACGCCAGTGCCCCTCCTAC<br>TTTTGGCGGAGGGACCAAGGTTGAGATCAAACGTACGGTGGCCG<br>CTCCCTCCGTGTTCATCTTCCCACCCTCCGACGAGCAGCTGAAG<br>TCCGGCACCGCCTCCGTCGTGTGCCTGCTGAACAACTTCTACCC<br>TCGCGAGGCCAAAGTGCAGTGGAAAGTGGACAACGCCCTGCAGT<br>CCGGCAACTCCCAGGAATCCGTCACCGAGCAGGACTCCAAGGAC<br>AGCACCTACTCCCTGTCCTCCACCCTGACCCTGTCCAAGGCCGA<br>CTACGAGAAGCACAAAGTGTACGCCTGCGAAGTGACCCACCAGG<br>GCCTGTCCAGCCCCGTGACCAAGTCCTTCAACCGGGGCGAGTGC |

SRF529-B

| 71 | Heavy Chain | EVQLVESGGGLVKPGGSLRLSCAASGFTFSSYSMNWVRQAPGKG<br>LEWVSSISSSSSYIYYADSVKGRFTISRDNAKNSLYLQMNSLRA<br>EDTAVYYCARDGGRTSYTATAHNWFDPWGQGTLVTVSSASTKGP<br>SVFPLAPCSRSTSESTAALGCLVKDYFPEPVTVSWNSGALTSGV<br>HTFPAVLQSSGLYSLSSVVTVPSSSLGTKTYTCNVDHKPSNTKV<br>DKRVESKYGPPCPSCPAPEFLGGPSVFLFPPKPKDTLMISRTPE<br>VTCVVVDVSQEDPEVQFNWYVDGVEVHNAKTKPREEQFNSTYRV<br>VSVLTVLHQDWLNGKEYKCKVSNKGLPSSIEKTISKAKGQPREP<br>QVYTLPPSQEEMTKNQVSLTCLVKGFYPSDIAVEWESNGQPENN<br>YKTTPPVLDSDGSFFLYSRLTVDKSRWQEGNVFSCSVMHEALHN<br>HYTQKSLSLSLG |
| 72 | DNA Heavy Chain | GAGGTGCAGCTGGTGGAGTCTGGGGGAGGCCTGGTCAAGCCTGG<br>GGGGTCCCTGAGACTCTCCTGTGCAGCCTCTGGATTCACCTTCA<br>GTAGCTATAGCATGAACTGGGTCCGCCAGGCTCCAGGGAAGGGG<br>CTGGAGTGGGTCTCATCCATTAGTAGTAGTAGTAGTTACATATA<br>CTACGCAGACTCAGTGAAGGGCCGATTCACCATCTCCAGAGACA<br>ACGCCAAGAACTCACTGTATCTGCAAATGAACAGCCTGAGAGCC<br>GAGGACACGGCGGTGTACTACTGCGCCAGAGATGGTGGAAGAAC<br>GTCCTACACCGCCACAGCCCACAATTGGTTCGACCCCTGGGGAC<br>AGGGTACATTGGTCACCGTCTCCTCAGCTTCCACCAAGGGCCCC<br>TCCGTGTTCCCTCTGGCCCCTTGCTCCCGGTCCACCTCCGAGTC<br>TACCGCCGCTCTGGGCTGCCTCGTGAAGGACTACTTCCCCGAGC<br>CCGTGACCGTGTCCTGGAACTCTGGCGCCCTGACCTCCGGCGTG<br>CACACCTTCCCTGCCGTGCTGCAGTCCTCCGGCCTGTACTCCCT<br>GTCCAGCGTCGTGACCGTGCCCTCCTCCAGCCTGGGCACCAAGA<br>CCTACACCTGTAACGTGGACCACAAGCCCTCCAACACCAAAGTG<br>GACAAGCGGGTGGAATCTAAGTACGGCCCTCCCTGCCCTTCCTG<br>CCCTGCCCCTGAGTTCCTGGGCGGACCTTCCGTGTTCCTGTTCC<br>CTCCAAAGCCCAAGGACACCCTGATGATCTCCCGGACCCCTGAA<br>GTGACCTGCGTGGTGGTGGACGTGTCCCAGGAAGATCCCGAAGT<br>CCAGTTCAATTGGTACGTGGACGGCGTGGAAGTGCACAACGCCA<br>AGACCAAGCCCAGAGAGGAACAGTTCAACTCCACCTACCGGGTG<br>GTGTCCGTGCTGACCGTGCTGCACCAGGACTGGCTGAACGGCAA<br>AGAGTACAAGTGCAAAGTGTCCAACAAGGGCCTGCCCTCCAGCA<br>TCGAAAAGACCATCTCCAAGGCCAAGGGCCAGCCCCGCGAGCCC<br>CAAGTGTACACCCTGCCTCCAGCCAGGAAGAGATGACCAAGAA<br>TCAAGTGTCCCTGACTTGTCTGGTCAAGGGCTTCTACCCCTCCG<br>ATATCGCCGTGGAGTGGGAGTCCAACGGCCAGCCCGAGAACAAC<br>TACAAGACCACCCCCTCCCGTGCTGGACTCCGACGGCTCCTTCTT |

TABLE 12-continued

SEQUENCE LISTING

| SEQ ID NO | Description | Sequence |
|---|---|---|
| | | CCTGTACTCTCGGCTGACCGTGGACAAGTCCCGGTGGCAGGAAG
GCAACGTCTTCTCCTGCTCCGTGATGCACGAGGCCCTGCACAAC
CACTACACCCAGAAGTCCCTGTCCCTGTCTCTGGGC |

SRF381-A

| SEQ ID NO | Description | Sequence |
|---|---|---|
| 73 | HCDR1 (IMGT) | GFTFRSYG |
| 74 | HCDR2 (IMGT) | ISSSSSYI |
| 75 | HCDR3 (IMGT) | ARDGGRTSYTATAHNWFDP |
| 76 | HCDR1 (NT) | FTFRSYGMN |
| 77 | HCDR2 (NT) | SISSSSSYIYYADSVKG |
| 78 | HCDR3 (NT) | ARDGGRTSYTATAHNWFDP |
| 79 | VH | EVQLVESGGGLVKPGGSLRLSCAASGFTFRSYGMNWVRQAPGKG
LEWVSSISSSSSYIYYADSVKGRFTISRDNAKNSLYLQMNSLRA
EDTAVYYCARDGGRTSYTATAHNWFDPWGQGTLVTVSS |
| 80 | DNA VH | GAGGTGCAGCTGGTGGAGTCTGGGGGAGGCCTGGTCAAGCCTGG
GGGGTCCCTGAGACTCTCCTGTGCAGCCTCTGGATTCACCTTCC
GGAGCTATGGGATGAACTGGGTCCGCCAGGCTCCAGGGAAGGGG
CTGGAGTGGGTCTCATCCATTAGTAGTAGTAGTAGTTACATATA
CTACGCAGACTCAGTGAAGGGCCGATTCACCATCTCCAGAGACA
ACGCCAAGAACTCACTGTATCTGCAAATGAACAGCCTGAGAGCC
GAGGACACGGCGGTGTACTACTGCGCCAGAGATGGTGGAAGAAC
GTCCTACACCGCCACAGCCCACAATTGGTTCGACCCCTGGGGAC
AGGGTACATTGGTCACCGTCTCCTCA |
| 81 | LCDR1 (IMGT) | QSVLFSSNNKNY |
| 82 | LCDR2 (IMGT) | WAS |
| 83 | LCDR3 (IMGT) | QQHASAPPT |
| 84 | LCDR1 (NT) | KSSQSVLFSSNNKNYLA |
| 85 | LCDR2 (NT) | WASTRES |
| 86 | LCDR3 (NT) | QQHASAPPT |
| 87 | VL | DIVMTQSPDSLAVSLGERATINCKSSQSVLFSSNNKNYLAWYQQ
KPGQPPKLLIYWASTRESGVPDRFSGSGSGTDFTLTISSLQAED
VAVYYCQQHASAPPTFGGGTKVEIK |
| 88 | DNA VL | GACATCGTGATGACCCAGTCTCCAGACTCCCTGGCTGTGTCTCT
GGGCGAGAGGGCCACCATCAACTGCAAGTCCAGCCAGAGTGTTT
TATTCAGCTCCAACAATAAGAACTACTTAGCTTGGTACCAGCAG
AAACCAGGACAGCCTCCTAAGCTGCTCATTTACTGGGCATCTAC
CCGGGGAATCCGGGGTCCCTGACCGATTCAGTGGCAGCGGGTCTG
GGACAGATTTCACTCTCACCATCAGCAGCCTGCAGGCTGAAGAT
GTGGCAGTTTATTACTGTCAGCAGCACGCCAGTGCCCCTCCTAC
TTTTGGCGGAGGGACCAAGGTTGAGATCAAA |
| 89 | Heavy Chain | EVQLVESGGGLVKPGGSLRLSCAASGFTFRSYGMNWVRQAPGKG
LEWVSSISSSSSYIYYADSVKGRFTISRDNAKNSLYLQMNSLRA
EDTAVYYCARDGGRTSYTATAHNWFDPWGQGTLVTVSSASTKGP
SVFPLAPSSKSTSGGTAALGCLVKDYFPEPVTVSWNSGALTSGV
HTFPAVLQSSGLYSLSSVVTVPSSSLGTQTYICNVNHKPSNTKV
DKKVEPKSCDKTHTCPPCPAPELLGGPSVFLFPPKPKDTLMISR
TPEVTCVVVDVSHEDPEVKFNWYVDGVEVHNAKTKPREEQYNST
YRVVSVLTVLHQDWLNGKEYKCKVSNKALPAPIEKTISKAKGQP
REPQVYTLPPSRDELTKNQVSLTCLVKGFYPSDIAVEWESNGQP
ENNYKTTPPVLDSDGSFFLYSKLTVDKSRWQQGNVFSCSVMHEA
LHNHYTQKSLSLSPGK |
| 90 | DNA Heavy Chain | GAGGTGCAGCTGGTGGAGTCTGGGGGAGGCCTGGTCAAGCCTGG
GGGGTCCCTGAGACTCTCCTGTGCAGCCTCTGGATTCACCTTCC
GGAGCTATGGGATGAACTGGGTCCGCCAGGCTCCAGGGAAGGGG
CTGGAGTGGGTCTCATCCATTAGTAGTAGTAGTAGTTACATATA
CTACGCAGACTCAGTGAAGGGCCGATTCACCATCTCCAGAGACA
ACGCCAAGAACTCACTGTATCTGCAAATGAACAGCCTGAGAGCC
GAGGACACGGCGGTGTACTACTGCGCCAGAGATGGTGGAAGAAC
GTCCTACACCGCCACAGCCCACAATTGGTTCGACCCCTGGGGAC
AGGGTACATTGGTCACCGTCTCCTCAGCGAGCACCAAAGGCCCG
AGCGTGTTTCCGCTGGCGCCAGCAGCAAAAGCACCAGCGGCGG
CACCGCGGCGCTGGGCTGCCTGGTGAAAGATTATTTTCCGGAAC
CGGTGACCGTGAGCTGGAACAGCGGCGCGCTGACCAGCGGCGTG
CATACCTTTCCGGCGGTGCTGCAGAGCAGCGGCCTGTATAGCCT
GAGCAGCGTGGTGACCGTGCCGAGCAGCAGCCTGGGCACCCAGA
CCTATATTTGCAACGTGAACCATAAACCGAGCAACACCAAAGTG
GATAAAAAAGTGGAACCGAAAAGCTGCGATAAACCCATACCTG
CCCGCCGTGCCCGGCGCCGGAACTGCTGGGCGGCCCGAGCGTGT |

TABLE 12-continued

SEQUENCE LISTING

| SEQ ID NO | Description | Sequence |
|---|---|---|
| | | TTCTGTTTCCGCCGAAACCGAAAGATACCCTGATGATTAGCCGC<br>ACCCCGGAAGTGACCTGCGTGGTGGTGGATGTGAGCCATGAAGA<br>TCCGGAAGTGAAATTTAACTGGTATGTGGATGGCGTGGAAGTGC<br>ATAACGCGAAAACCAAACCGCGCGAAGAACAGTATAACAGCACC<br>TATCGCGTGGTGAGCGTGCTGACCGTGCTGCATCAGGATTGGCT<br>GAACGGCAAAGAATATAAATGCAAAGTGAGCAACAAAGCGCTGC<br>CGGCGCCGATTGAAAAAACCATTAGCAAAGCGAAAGGCCAGCCG<br>CGCGAACCGCAGGTGTATACCCTGCCGCCGAGCCGCGATGAACT<br>GACCAAAAACCAGGTGAGCCTGACCTGCCTGGTGAAAGGCTTTT<br>ATCCGAGCGATATTGCGGTGGAATGGGAAAGCAACGGCCAGCCG<br>GAAAACAACTATAAAACCACCCCGCCGGTGCTGGATAGCGATGG<br>CAGCTTTTTTCTGTATAGCAAACTGACCGTGGATAAAAGCCGCT<br>GGCAGCAGGGCAACGTGTTTAGCTGCAGCGTGATGCATGAAGCG<br>CTGCATAACCATTATACCCAGAAAAGCCTGAGCCTGAGCCCGGG<br>CAAA |
| 91 | Light Chain | DIVMTQSPDSLAVSLGERATINCKSSQSVLFSSNNKNYLAWYQQ<br>KPGQPPKLLIYWASTRESGVPDRFSGSGSGTDFTLTISSLQAED<br>VAVYYCQQHASAPPTFGGGTKVEIKRTVAAPSVFIFPPSDEQLK<br>SGTASVVCLLNNFYPREAKVQWKVDNALQSGNSQESVTEQDSKD<br>STYSLSSTLTLSKADYEKHKVYACEVTHQGLSSPVTKSFNRGEC |
| 92 | DNA Light Chain | GACATCGTGATGACCCAGTCTCCAGACTCCCTGGCTGTGTCTCT<br>GGGCGAGAGGGCCACCATCAACTGCAAGTCCAGCCAGAGTGTTT<br>TATTCAGCTCCAACAATAAGAACTACTTAGCTTGGTACCAGCAG<br>AAACCAGGACAGCCTCCTAAGCTGCTCATTTACTGGGCATCTAC<br>CCGGGAATCCGGGGTCCCTGACCGATTCAGTGGCAGCGGGTCTG<br>GGACAGATTTCACTCTCACCATCAGCAGCCTGCAGGCTGAAGAT<br>GTGGCAGTTTATTACTGTCAGCAGCACGCCAGTGCCCCTCCTAC<br>TTTTGGCGGAGGGACCAAGGTTGAGATCAAACGTACGGTGGCCG<br>CTCCCTCCGTGTTCATCTTCCCACCCTCCGACGAGCAGCTGAAG<br>TCCGGCACCGCCTCCGTCGTGTGCCTGCTGAACAACTTCTACCC<br>TCGCGAGGCCAAAGTGCAGTGGAAAGTGGACAACGCCCTGCAGT<br>CCGGCAACTCCCAGGAATCCGTCACCGAGCAGGACTCCAAGGAC<br>AGCACCTACTCCCTGTCCTCCACCCTGACCCTGTCCAAGGCCGA<br>CTACGAGAAGCACAAAGTGTACGCCTGCGAAGTGACCCACCAGG<br>GCCTGTCCAGCCCCGTGACCAAGTCCTTCAACCGGGGCGAGTGC |

SRF381-B

| 93 | Heavy Chain | EVQLVESGGGLVKPGGSLRLSCAASGFTFRSYGMNWVRQAPGKG<br>LEWVSSISSSSSYIYYADSVKGRFTISRDNAKNSLYLQMNSLRA<br>EDTAVYYCARDGGRTSYTATAHNWFDPWGQGTLVTVSSASTKGP<br>SVFPLAPCSRSTSESTAALGCLVKDYFPEPVTVSWNSGALTSGV<br>HTFPAVLQSSGLYSLSSVVTVPSSSLGTKTYTCNVDHKPSNTKV<br>DKRVESKYGPPCPSCPAPEFLGGPSVFLFPPKPKDTLMISRTPE<br>VTCVVVDVSQEDPEVQFNWYVDGVEVHNAKTKPREEQFNSTYRV<br>VSVLTVLHQDWLNGKEYKCKVSNKGLPSSIEKTISKAKGQPREP<br>QVYTLPPSQEEMTKNQVSLTCLVKGFYPSDIAVEWESNGQPENN<br>YKTTPPVLDSDGSFFLYSRLTVDKSRWQEGNVFSCSVMHEALHN<br>HYTQKSLSLSLG |
| 94 | DNA Heavy Chain | GAGGTGCAGCTGGTGGAGTCTGGGGGAGGCCTGGTCAAGCCTGG<br>GGGGTCCCTGAGACTCTCCTGTGCAGCCTCTGGATTCACCTTCC<br>GGAGCTATGGGATGAACTGGGTCCGCCAGGCTCCAGGGAAGGGG<br>CTGGAGTGGGTCTCATCCATTAGTAGTAGTAGTAGTTACATATA<br>CTACGCAGACTCAGTGAAGGGCCGATTCACCATCTCCAGAGACA<br>ACGCCAAGAACTCACTGTATCTGCAAATGAACAGCCTGAGAGCC<br>GAGGACACGGCGGTGTACTACTGCGCCAGAGATGGTGGAAGAAC<br>GTCCTACACCGCCACAGCCCACAATTGGTTCGACCCCTGGGGAC<br>AGGGTACATTGGTCACCGTCTCCTCAGCTTCCACCAAGGGCCCC<br>TCCGTGTTCCCTCTGGCCCCTTGCTCCCGGTCCACCTCCGAGTC<br>TACCGCCGCTCTGGGCTGCCTCGTGAAGGACTACTTCCCCGAGC<br>CCGTGACCGTGTCCTGGAACTCTGGCGCCCTGACCTCCGGCGTG<br>CACACCTTCCCTGCCGTGCTGCAGTCCTCCGGCCTGTACTCCCT<br>GTCCAGCGTCGTGACCGTGCCCTCCTCCAGCCTGGGCACCAAGA<br>CCTACACCTGTAACGTGGACCACAAGCCCTCCAACACCAAAGTG<br>GACAAGCGGGTGGAATCTAAGTACGGCCCCTCCCTGCCCTTCCTG<br>CCCTGCCCCTGAGTTCCTGGGCGGACCTTCCGTGTTCCTGTTCC<br>CTCCAAAGCCCAAGGACACCCTGATGATCTCCCGGACCCCTGAA<br>GTGACCTGCGTGGTGGTGGACGTGTCCCAGGAAGATCCCGAAGT<br>CCAGTTCAATTGGTACGTGGACGGCGTGGAAGTGCACAACGCCA<br>AGACCAAGCCCAGAGAGGAACAGTTCAACTCCACCTACCGGGTG<br>GTGTCCGTGCTGACCGTGCTGCACCAGGACTGGCTGAACGGCAA<br>AGAGTACAAGTGCAAAGTGTCCAACAAGGGCCTGCCCTCCAGCA<br>TCGAAAAGACCATCTCCAAGGCCAAGGGCCAGCCCCGCGAGCCC<br>CAAGTGTACACCCTGCCTCCCAGCCAGGAAGAGATGACCAAGAA<br>TCAAGTGTCCCTGACTTGTCTGGTCAAGGGCTTCTACCCCTCCG |

TABLE 12-continued

SEQUENCE LISTING

| SEQ ID NO | Description | Sequence |
|---|---|---|
| | | ATATCGCCGTGGAGTGGGAGTCCAACGGCCAGCCCGAGAACAAC<br>TACAAGACCACCCCTCCCGTGCTGGACTCCGACGGCTCCTTCTT<br>CCTGTACTCTCGGCTGACCGTGGACAAGTCCCGGTGGCAGGAAG<br>GCAACGTCTTCTCCTGCTCCGTGATGCACGAGGCCCTGCACAAC<br>CACTACACCCAGAAGTCCCTGTCCCTGTCTCTGGGC |

SRF382-A

| 95 | HCDR1 (IMGT) | GFTFSRTG |
|---|---|---|
| 96 | HCDR2 (IMGT) | ISSSSSYI |
| 97 | HCDR3 (IMGT) | ARDGGRTSYTATAHNWFDP |
| 98 | HCDR1 (NT) | FTFSRTGMN |
| 99 | HCDR2 (NT) | SISSSSSYIYYADSVKG |
| 100 | HCDR3 (NT) | ARDGGRTSYTATAHNWFDP |
| 101 | VH | EVQLVESGGGLVKPGGSLRLSCAASGFTFSRTGMNWVRQAPGKG<br>LEWVSSISSSSSYIYYADSVKGRFTISRDNAKNSLYLQMNSLRA<br>EDTAVYYCARDGGRTSYTATAHNWFDPWGQGTLVTVSS |
| 102 | DNA VH | GAGGTGCAGCTGGTGGAGTCTGGGGGAGGCCTGGTCAAGCCTGG<br>GGGGTCCCTGAGACTCTCCTGTGCAGCCTCTGGATTCACCTTCA<br>GTAGGACTGGGATGAACTGGGTCCGCCAGGCTCCAGGGAAGGGG<br>CTGGAATGGGTCTCATCCATTAGTAGTAGTAGTAGTTACATATA<br>CTACGCAGACTCAGTGAAGGGCCGATTCACCATCTCCAGAGACA<br>ACGCCAAGAACTCACTGTATCTGCAAATGAACAGCCTGAGAGCC<br>GAGGACACGGCGGTGTACTACTGCGCCAGAGATGGTGGAAGAAC<br>GTCCTACACCGCCACAGCCCACAATTGGTTCGACCCCTGGGGAC<br>AGGGTACATTGGTCACCGTCTCCTCA |
| 103 | LCDR1 (IMGT) | QSVLFSSNNKNY |
| 104 | LCDR2 (IMGT) | WAS |
| 105 | LCDR3 (IMGT) | QQHASAPPT |
| 106 | LCDR1 (NT) | KSSQSVLFSSNNKNYLA |
| 107 | LCDR2 (NT) | WASTRES |
| 108 | LCDR3 (NT) | QQHASAPPT |
| 109 | VL | DIVMTQSPDSLAVSLGERATINCKSSQSVLFSSNNKNYLAWYQQ<br>KPGQPPKLLIYWASTRESGVPDRFSGSGSGTDFTLTISSLQAED<br>VAVYYCQQHASAPPTFGGGTKVEIK |
| 110 | DNA VL | GACATCGTGATGACCCAGTCTCCAGACTCCCTGGCTGTGTCTCT<br>GGGCGAGAGGGCCACCATCAACTGCAAGTCCAGCCAGAGTGTTT<br>TATTCAGCTCCAACAATAAGAACTACTTAGCTTGGTACCAGCAG<br>AAACCAGGACAGCCTCCTAAGCTGCTCATTTACTGGGCATCTAC<br>CCGGGAATCCGGGGTCCCTGACCGATTCAGTGGCAGCGGGTCTG<br>GGACAGATTTCACTCTCACCATCAGCAGCCTGCAGGCTGAAGAT<br>GTGGCAGTTTATTACTGTCAGCAGCACGCCAGTGCCCCTCCTAC<br>TTTTGGCGGAGGGACCAAGGTTGAGATCAAA |
| 111 | Heavy Chain | EVQLVESGGGLVKPGGSLRLSCAASGFTFSRTGMNWVRQAPGKG<br>LEWVSSISSSSSYIYYADSVKGRFTISRDNAKNSLYLQMNSLRA<br>EDTAVYYCARDGGRTSYTATAHNWFDPWGQGTLVTVSSASTKGP<br>SVFPLAPSSKSTSGGTAALGCLVKDYFPEPVTVSWNSGALTSGV<br>HTFPAVLQSSGLYSLSSVVTVPSSSLGTQTYICNVNHKPSNTKV<br>DKKVEPKSCDKTHTCPPCPAPELLGGPSVFLFPPKPKDTLMISR<br>TPEVTCVVVDVSHEDPEVKFNWYVDGVEVHNAKTKPREEQYNST<br>YRVVSVLTVLHQDWLNGKEYKCKVSNKALPAPIEKTISKAKGQP<br>REPQVYTLPPSRDELTKNQVSLTCLVKGFYPSDIAVEWESNGQP<br>ENNYKTTPPVLDSDGSFFLYSKLTVDKSRWQQGNVFSCSVMHEA<br>LHNHYTQKSLSLSPGK |
| 112 | DNA Heavy Chain | GAGGTGCAGCTGGTGGAGTCTGGGGGAGGCCTGGTCAAGCCTGG<br>GGGGTCCCTGAGACTCTCCTGTGCAGCCTCTGGATTCACCTTCA<br>GTAGGACTGGGATGAACTGGGTCCGCCAGGCTCCAGGGAAGGGG<br>CTGGAATGGGTCTCATCCATTAGTAGTAGTAGTAGTTACATATA<br>CTACGCAGACTCAGTGAAGGGCCGATTCACCATCTCCAGAGACA<br>ACGCCAAGAACTCACTGTATCTGCAAATGAACAGCCTGAGAGCC<br>GAGGACACGGCGGTGTACTACTGCGCCAGAGATGGTGGAAGAAC<br>GTCCTACACCGCCACAGCCCACAATTGGTTCGACCCCTGGGGAC<br>AGGGTACATTGGTCACCGTCTCCTCAGCGAGCACCAAGGGCCCG<br>AGCGTGTTCCCGCTGGCGCCGAGCAGCAAAAGCACCAGCGGCGC<br>CACCGCGGCGCTGGGCTGCCTGGTGAAAGATTATTTTCCGGAAC<br>CGGTGACCGTGAGCTGGAACAGCGGCGCGCTGACCAGCGGCGTG<br>CATACCTTTCCGGCGGTGCTGCAGAGCAGCGGCCTGTATAGCCT<br>GAGCAGCGTGGTGACCGTGCCGAGCAGCAGCCTGGGCACCCAGA<br>CCTATATTTGCAACGTGAACCATAAACCGAGCAACACCAAAGTG |

TABLE 12-continued

SEQUENCE LISTING

| SEQ ID NO | Description | Sequence |
|---|---|---|
| | | GATAAAAAAGTGGAACCGAAAAGCTGCGATAAAACCCATACCTG<br>CCCGCCGTGCCCGGCGCCGGAACTGCTGGGCGGCCCGAGCGTGT<br>TTCTGTTTCCGCCGAAACCGAAAGATACCCTGATGATTAGCCGC<br>ACCCCGGAAGTGACCTGCGTGGTGGATGTGAGCCATGAAGA<br>TCCGGAAGTGAAATTTAACTGGTATGTGGATGGCGTGGAAGTGC<br>ATAACGCGAAAACCAAACCGCGCGAAGAACAGTATAACAGCACC<br>TATCCGTGGTGAGCGTGCTGACCGTGCTGCATCAGGATTGGCT<br>GAACGGCAAAGAATATAAATGCAAAGTGAGCAACAAAGCGCTGC<br>CGGCGCCGATTGAAAAAACCATTAGCAAAGCGAAAGGCCAGCCG<br>CGCGAACCGCAGGTGTATACCCTGCCGCCGAGCCGCGATGAACT<br>GACCAAAAACCAGGTGAGCCTGACCTGCCTGGTGAAAGGCTTTT<br>ATCCGAGCGATATTGCGGTGGAATGGGAAAGCAACGGCCAGCCG<br>GAAAACAACTATAAAACCACCCCGCCGGTGCTGGATAGCGATGG<br>CAGCTTTTTTCTGTATAGCAAACTGACCGTGGATAAAAGCCGCT<br>GGCAGCAGGGCAACGTGTTTAGCTGCAGCGTGATGCATGAAGCG<br>CTGCATAACCATTATACCCAGAAAAGCCTGAGCCTGAGCCCGGG<br>CAAA |
| 113 | Light Chain | DIVMTQSPDSLAVSLGERATINCKSSQSVLFSSNNKNYLAWYQQ<br>KPGQPPKLLIYWASTRESGVPDRFSGSGSGTDFTLTISSLQAED<br>VAVYYCQQHASAPPTFGGGTKVEIKRTVAAPSVFIFPPSDEQLK<br>SGTASVVCLLNNFYPREAKVQWKVDNALQSGNSQESVTEQDSKD<br>STYSLSSTLTLSKADYEKHKVYACEVTHQGLSSPVTKSFNRGEC |
| 114 | DNA Light Chain | GACATCGTGATGACCCAGTCTCCAGACTCCCTGGCTGTGTCTCT<br>GGGCGAGAGGGCCACCATCAACTGCAAGTCCAGCCAGAGTGTTT<br>TATTCAGCTCCAACAATAAGAACTACTTAGCTTGGTACCAGCAG<br>AAACCAGGACAGCCTCCTAAGCTGCTCATTTACTGGGCATCTAC<br>CCGGGAATCCGGGGTCCCTGACCGATTCAGTGGCAGCGGGTCTG<br>GGACAGATTTCACTCTCACCATCAGCAGCCTGCAGGCTGAAGAT<br>GTGGCAGTTTATTACTGTCAGCAGCACGCCAGTGCCCCTCCTAC<br>TTTTGGCGGAGGGACCAAGGTTGAGATCAAACGTACGGTGGCCG<br>CTCCCTCCGTGTTCATCTTCCCACCCTCCGACGAGCAGCTGAAG<br>TCCGGCACCGCCTCCGTCGTGTGCCTGCTGAACAACTTCTACCC<br>TCGCGAGGCCAAAGTGCAGTGGAAAGTGGACAACGCCCTGCAGT<br>CCGGCAACTCCCAGGAATCCGTCACCGAGCAGGACTCCAAGGAC<br>AGCACCTACTCCCTGTCCTCCACCCTGACCCTGTCCAAGGCCGA<br>CTACGAGAAGCACAAAGTGTACGCCTGCGAAGTGACCCACCAGG<br>GCCTGTCCAGCCCCGTGACCAAGTCCTTCAACCGGGGCGAGTGC |

SRF382-B

| SEQ ID NO | Description | Sequence |
|---|---|---|
| 115 | Heavy Chain | EVQLVESGGGLVKPGGSLRLSCAASGFTFSRTGMNWVRQAPGKG<br>LEWVSSISSSSSYIYYADSVKGRFTISRDNAKNSLYLQMNSLRA<br>EDTAVYYCARDGGRTSYTATAHNWFDPWGQGTLVTVSSASTKGP<br>SVFPLAPCSRSTSESTAALGCLVKDYFPEPVTVSWNSGALTSGV<br>HTFPAVLQSSGLYSLSSVVTVPSSSLGTKTYTCNVDHKPSNTKV<br>DKRVESKYGPPCPSCPAPEFLGGPSVFLFPPKPKDTLMISRTPE<br>VTCVVVDVSQEDPEVQFNWYVDGVEVHNAKTKPREEQFNSTYRV<br>VSVLTVLHQDWLNGKEYKCKVSNKGLPSSIEKTISKAKGQPREP<br>QVYTLPPSQEEMTKNQVSLTCLVKGFYPSDIAVEWESNGQPENN<br>YKTTPPVLDSDGSFFLYSRLTVDKSRWQEGNVFSCSVMHEALHN<br>HYTQKSLSLSLG |
| 116 | DNA Heavy Chain | GAGGTGCAGCTGGTGGAGTCTGGGGGAGGCCTGGTCAAGCCTGG<br>GGGGTCCCTGAGACTCTCCTGTGCAGCCTCTGGATTCACCTTCA<br>GTAGGACTGGGATGAACTGGGTCCGCCAGGCTCCAGGGAAGGGG<br>CTGGAATGGGTCTCATCCATTAGTAGTAGTAGTAGTTACATATA<br>CTACGCAGACTCAGTGAAGGGCCGATTCACCATCTCCAGAGACA<br>ACGCCAAGAACTCACTGTATCTGCAAATGAACAGCCTGAGAGCC<br>GAGGACACGGCGGTGTACTACTGCGCCAGAGATGGTGGAAGAAC<br>GTCCTACACCGCCACAGCCCACAATTGGTTCGACCCCTGGGGAC<br>AGGGTACATTGGTCACCGTCCTCAGCTTCCACCAAGGGCCCC<br>TCCGTGTTCCCTCTGGCCCCTTGCTCCCGGTCCACCTCCGAGTC<br>TACCGCCGCTCTGGGCTGCCTCGTGAAGGACTACTTCCCCGAGC<br>CCGTGACCGTGTCCTGGAACTCTGGCGCCCTGACCTCCGGCGTG<br>CACACCTTCCCTGCCGTGCTGCAGTCCTCCGGCCTGTACTCCCT<br>GTCCAGCGTCGTGACCGTGCCCTCCTCCAGCCTGGGCACCAAGA<br>CCTACACCTGTAACGTGGACCACAAGCCCTCCAACACCAAAGTG<br>GACAAGCGGGTGGAATCTAAGTACGCCCTCCCTGCCCTTCCTG<br>CCCTGCCCCTGAGTTCCTGGGCGGACCTTCCGTGTTCCTGTTCC<br>CTCCAAAGCCCAAGGACACCCTGATGATCTCCCGGACCCCTGAA<br>GTGACCTGCGTGGTGGTGGACGTGTCCCAGGAAGATCCCGAAGT<br>CCAGTTCAATTGGTACGTGGACGGCGTGGAAGTGCACAACGCCA<br>AGACCAAGCCCAGAGAGGAACAGTTCAACTCCACCTACCGGGTG<br>GTGTCCGTGCTGACCGTGCTGCACCAGGACTGGCTGAACGGCAA<br>AGAGTACAAGTGCAAAGTGTCCAACAAGGGCCTGCCCTCCAGCA<br>TCGAAAAGACCATCTCCAAGGCCAAGGGCCAGCCCCGCGAGCCC |

TABLE 12-continued

SEQUENCE LISTING

| SEQ ID NO | Description | Sequence |
|---|---|---|
| | | CAAGTGTACACCCTGCCTCCCAGCCAGGAAGAGATGACCAAGAA |
| | | TCAAGTGTCCCTGACTTGTCTGGTCAAGGGCTTCTACCCCTCCG |
| | | ATATCGCCGTGGAGTGGGAGTCCAACGGCCAGCCCGAGAACAAC |
| | | TACAAGACCACCCCTCCCGTGCTGGACTCCGACGGCTCCTTCTT |
| | | CCTGTACTCTCGGCTGACCGTGGACAAGTCCCGGTGGCAGGAAG |
| | | GCAACGTCTTCTCCTGCTCCGTGATGCACGAGGCCCTGCACAAC |
| | | CACTACACCCAGAAGTCCCTGTCCCTGTCTCTGGGC |

SRF384-A

| 117 | HCDR1 (IMGT) | GFTFSRYG |
| 118 | HCDR2 (IMGT) | ISSSSAYI |
| 119 | HCDR3 (IMGT) | ARDGGRTSYTATAHNWFDP |
| 120 | HCDR1 (NT) | FTFSRYGMN |
| 121 | HCDR2 (NT) | SISSSSAYILYADSVKG |
| 122 | HCDR3 (NT) | ARDGGRTSYTATAHNWFDP |
| 123 | VH | EVQLVESGGGLVKPGGSLRLSCAASGFTFSRYGMNWVRQAPGKG |
| | | LEWVSSISSSSAYILYADSVKGRFTISRDNAKNSLYLQMNSLRA |
| | | EDTAVYYCARDGGRTSYTATAHNWFDPWGQGTLVTVSS |
| 124 | DNA VH | GAGGTGCAGCTGGTGGAGTCTGGGGGAGGCCTGGTCAAGCCTGG |
| | | GGGGTCCCTGAGACTCTCCTGTGCAGCCTCTGGATTCACCTTCA |
| | | GTAGGTATGGGATGAACTGGGTCCGCCAGGCTCCAGGGAAGGGG |
| | | CTGGAGTGGGTCTCATCCATTAGTAGTAGTAGTGCTTACATACT |
| | | GTACGCAGACTCAGTGAAGGGCCGATTCACCATCTCCAGAGACA |
| | | ACGCCAAGAACTCACTGTATCTGCAAATGAACAGCCTGAGAGCC |
| | | GAGGACACGGCGGTGTACTACTGCGCCAGAGATGGTGGAAGAAC |
| | | GTCCTACACCGCCACAGCCCACAATTGGTTCGACCCCTGGGGAC |
| | | AGGGTACATTGGTCACCGTCTCCTCA |
| 125 | LCDR1 (IMGT) | QSVLFSSNNKNY |
| 126 | LCDR2 (IMGT) | WAS |
| 127 | LCDR3 (IMGT) | QQHASAPPT |
| 128 | LCDR1 (NT) | KSSQSVLFSSNNKNYLA |
| 129 | LCDR2 (NT) | WASTRES |
| 130 | LCDR3 (NT) | QQHASAPPT |
| 131 | VL | DIVMTQSPDSLAVSLGERATINCKSSQSVLFSSNNKNYLAWYQQ |
| | | KPGQPPKLLIYWASTRESGVPDRFSGSGSGTDFTLTISSLQAED |
| | | VAVYYCQQHASAPPTFGGGTKVEIK |
| 132 | DNA VL | GACATCGTGATGACCCAGTCTCCAGACTCCCTGGCTGTGTCTCT |
| | | GGGCGAGAGGGCCACCATCAACTGCAAGTCCAGCCAGAGTGTTT |
| | | TATTCAGCTCCAACAATAAGAACTACTTAGCTTGGTACCAGCAG |
| | | AAACCAGGACAGCCTCCTAAGCTGCTCATTTACTGGGCATCTAC |
| | | CCGGGAATCCGGGGTCCCTGACCGATTCAGTGGCAGCGGGTCTG |
| | | GGACAGATTTCACTCTCACCATCAGCAGCCTGCAGGCTGAAGAT |
| | | GTGGCAGTTTATTACTGTCAGCAGCACGCCAGTGCCCCTCCTAC |
| | | TTTTGGCGGAGGGACCAAGGTTGAGATCAAA |
| 133 | Heavy Chain | EVQLVESGGGLVKPGGSLRLSCAASGFTFSRYGMNWVRQAPGKG |
| | | LEWVSSISSSSAYILYADSVKGRFTISRDNAKNSLYLQMNSLRA |
| | | EDTAVYYCARDGGRTSYTATAHNWFDPWGQGTLVTVSSASTKGP |
| | | SVFPLAPSSKSTSGGTAALGCLVKDYFPEPVTVSWNSGALTSGV |
| | | HTFPAVLQSSGLYSLSSVVTVPSSSLGTQTYICNVNHKPSNTKV |
| | | DKKVEPKSCDKTHTCPPCPAPELLGGPSVFLFPPKPKDTLMISR |
| | | TPEVTCVVVDVSHEDPEVKFNWYVDGVEVHNAKTKPREEQYNST |
| | | YRVVSVLTVLHQDWLNGKEYKCKVSNKALPAPIEKTISKAKGQP |
| | | REPQVYTLPPSRDELTKNQVSLTCLVKGFYPSDIAVEWESNGQP |
| | | ENNYKTTPPVLDSDGSFFLYSKLTVDKSRWQQGNVFSCSVMHEA |
| | | LHNHYTQKSLSLSPGK |
| 134 | DNA Heavy Chain | GAGGTGCAGCTGGTGGAGTCTGGGGGAGGCCTGGTCAAGCCTGG |
| | | GGGGTCCCTGAGACTCTCCTGTGCAGCCTCTGGATTCACCTTCA |
| | | GTAGGTATGGGATGAACTGGGTCCGCCAGGCTCCAGGGAAGGGG |
| | | CTGGAGTGGGTCTCATCCATTAGTAGTAGTAGTGCTTACATACT |
| | | GTACGCAGACTCAGTGAAGGGCCGATTCACCATCTCCAGAGACA |
| | | ACGCCAAGAACTCACTGTATCTGCAAATGAACAGCCTGAGAGCC |
| | | GAGGACACGGCGGTGTACTACTGCGCCAGAGATGGTGGAAGAAC |
| | | GTCCTACACCGCCACAGCCCACAATTGGTTCGACCCCTGGGGAC |
| | | AGGGTACATTGGTCACCGTCTCCTCAGCGAGCACCAAAGGCCCG |
| | | AGCGTGTTCCCGCTGGCGCCAGCAGCAAAGCACCAGCGGCGG |
| | | CACCGCGGCGCTGGGCTGCCTGGTGAAGATTATTTTCCGGAAC |
| | | CGGTGACCGTGAGCTGGAACAGCGGCGCGCTGACCAGCGGCGTG |
| | | CATACCTTTCCGGCGGTGCTGCAGAGCAGCGGCCTGTATAGCCT |

TABLE 12-continued

SEQUENCE LISTING

| SEQ ID NO | Description | Sequence |
|---|---|---|
| | | GAGCAGCGTGGTGACCGTGCCGAGCAGCAGCCTGGGCACCCAGA<br>CCTATATTTGCAACGTGAACCATAAACCGAGCAACACCAAAGTG<br>GATAAAAAAGTGGAACCGAAAAGCTGCGATAAAACCCATACCTG<br>CCCGCCGTGCCCGGCGCCGGAACTGCTGGGCGGCCCGAGCGTGT<br>TTCTGTTTCCGCCGAAACCGAAAGATACCCTGATGATTAGCCGC<br>ACCCCGGAAGTGACCTGCGTGGTGGTGGATGTGAGCCATGAAGA<br>TCCGGAAGTGAAATTTAACTGGTATGTGGATGGCGTGGAAGTGC<br>ATAACGCGAAAACCAAACCGCGCGAAGAACAGTATAACAGCACC<br>TATCGCGTGGTGAGCGTGCTGACCGTGCTGCATCAGGATTGGCT<br>GAACGGCAAAGAATATAAATGCAAAGTGAGCAACAAAGCGCTGC<br>CGGCGCCGATTGAAAAAACCATTAGCAAAGCGAAAGGCCAGCCG<br>CGCGAACCGCAGGTGTATACCCTGCCGCCGAGCCGCGATGAACT<br>GACCAAAAACCAGGTGAGCCTGACCTGCCTGGTGAAAGGCTTTT<br>ATCCGAGCGATATTGCGGTGGAATGGGAAAGCAACGGCCAGCCG<br>GAAAACAACTATAAAACCACCCCGCCGGTGCTGGATAGCGATGG<br>CAGCTTTTTTCTGTATAGCAAACTGACCGTGGATAAAAGCCGCT<br>GGCAGCAGGGCAACGTGTTTAGCTGCAGCGTGATGCATGAAGCG<br>CTGCATAACCATTATACCCAGAAAAGCCTGAGCCTGAGCCCGGG<br>CAAA |
| 135 | Light Chain | DIVMTQSPDSLAVSLGERATINCKSSQSVLFSSNNKNYLAWYQQ<br>KPGQPPKLLIYWASTRESGVPDRFSGSGSGTDFTLTISSLQAED<br>VAVYYCQQHASAPPTFGGGTKVEIKRTVAAPSVFIFPPSDEQLK<br>SGTASVVCLLNNFYPREAKVQWKVDNALQSGNSQESVTEQDSKD<br>STYSLSSTLTLSKADYEKHKVYACEVTHQGLSSPVTKSFNRGEC |
| 136 | DNA Light Chain | GACATCGTGATGACCCAGTCTCCAGACTCCCTGGCTGTGTCTCT<br>GGGCGAGAGGGCCACCATCAACTGCAAGTCCAGCCAGAGTGTTT<br>TATTCAGCTCCAACAATAAGAACTACTTAGCTTGGTACCAGCAG<br>AAACCAGGACAGCCTCCTAAGCTGCTCATTTACTGGGCATCTAC<br>CCGGGAATCCGGGGTCCCTGACCGATTCAGTGGCAGCGGGTCTG<br>GGACAGATTTCACTCTCACCATCAGCAGCCTGCAGGCTGAAGAT<br>GTGGCAGTTTATTACTGTCAGCAGCACGCCAGTGCCCCTCCTAC<br>TTTTGGCGGAGGGACCAAGGTTGAGATCAAACGTACGGTGGCCG<br>CTCCCTCCGTGTTCATCTTCCCACCCTCCGACGAGCAGCTGAAG<br>TCCGGCACCGCCTCCGTCGTGTGCCTGCTGAACAACTTCTACCC<br>TCGCGAGGCCAAAGTGCAGTGGAAAGTGGACAACGCCCTGCAGT<br>CCGGCAACTCCCAGGAATCCGTCACCGAGCAGGACTCCAAGGAC<br>AGCACCTACTCCCTGTCCTCCACCCTGACCCTGTCCAAGGCCGA<br>CTACGAGAAGCACAAAGTGTACGCCTGCGAAGTGACCCACCAGG<br>GCCTGTCCAGCCCCGTGACCAAGTCCTTCAACCGGGGCGAGTGC |

SRF384-B

| 137 | Heavy Chain | EVQLVESGGGLVKPGGSLRLSCAASGFTFSRYGMNWVRQAPGKG<br>LEWVSSISSSSAYILYADSVKGRFTISRDNAKNSLYLQMNSLRA<br>EDTAVYYCARDGGRTSYTATAHNWFDPWGQGTLVTVSSASTKGP<br>SVFPLAPCSRSTSESTAALGCLVKDYFPEPVTVSWNSGALTSGV<br>HTFPAVLQSSGLYSLSSVVTVPSSSLGTKTYTCNVDHKPSNTKV<br>DKRVESKYGPPCPSCPAPEFLGGPSVFLFPPKPKDTLMISRTPE<br>VTCVVVDVSQEDPEVQFNWYVDGVEVHNAKTKPREEQFNSTYRV<br>VSVLTVLHQDWLNGKEYKCKVSNKGLPSSIEKTISKAKGQPREP<br>QVYTLPPSQEEMTKNQVSLTCLVKGFYPSDIAVEWESNGQPENN<br>YKTTPPVLDSDGSFFLYSRLTVDKSRWQEGNVFSCSVMHEALHN<br>HYTQKSLSLSLG |
| 138 | DNA Heavy Chain | GAGGTGCAGCTGGTGGAGTCTGGGGGAGGCTGGTCAAGCCTGG<br>GGGGTCCCTGAGACTCTCCTGTGCAGCCTCTGGATTCACCTTCA<br>GTAGGTATGGGATGAACTGGGTCCGCCAGGCTCCAGGGAAGGGG<br>CTGGAGTGGGTCTCATCCATTAGTAGTAGTAGTGCTTACATACT<br>GTACGCAGACTCAGTGAAGGGCCGATTCACCATCTCCAGAGACA<br>ACGCCAAGAACTCACTGTATCTGCAAATGAACAGCCTGAGAGCC<br>GAGGACACGGCGGTGTACTACTGCGCCAGAGATGGTGGAAGAAC<br>GTCCTACACCGCCACAGCCCACAATTGGTTCGACCCCTGGGGAC<br>AGGGTACATTGGTCACCGTCTCCTCAGCTTCCACCAAGGGCCC<br>TCCGTGTTCCCTCTGGCCCCTTGCTCCGGTCCACCTCCGAGTC<br>TACCGCCGCTCTGGGCTGCCTCGTGAAGGACTACTTCCCCGAGC<br>CCGTGACCGTGTCCTGGAACTCTGGCGCCCTGACCTCCGGCGTG<br>CACACCTTCCCTGCCGTGCTGCAGTCCTCCGGCCTGTACTCCCT<br>GTCCAGCGTCGTGACCGTGCCCTCCTCCAGCCTGGGCACCAAGA<br>CCTACACCTGTAACGTGGACCACAAGCCCTCCAACACCAAAGTG<br>GACAAGCGGGTGGAATCTAAGTACGGCCCTCCCTGCCCTTCCTG<br>CCCTGCCCCTGAGTTCCTGGGCGGACCTTCCGTGTTCCTGTTCC<br>CTCCAAAGCCCAAGGACACCCTGATGATCTCCCGGACCCCTGAA<br>GTGACCTGCGTGGTGGTGACGTGTCCCAGGAAGATCCCGAAGT<br>CCAGTTCAATTGGTACGTGGACGGCGTGGAAGTGCACAACGCCA<br>AGACCAAGCCCAGAGAGGAACAGTTCAACTCCACCTACCGGGTG<br>GTGTCCGTGCTGACCGTGCTGCACCAGGACTGGCTGAACGGCAA |

TABLE 12-continued

SEQUENCE LISTING

| SEQ ID NO | Description | Sequence |
|---|---|---|
| | | AGAGTACAAGTGCAAAGTGTCCAACAAGGGCCTGCCCTCCAGCA TCGAAAAGACCATCTCCAAGGCCAAGGGCCAGCCCCGCGAGCCC CAAGTGTACACCCTGCCTCCCAGCCAGGAAGAGATGACCAAGAA TCAAGTGTCCCTGACTTGTCTGGTCAAGGGCTTCTACCCCTCCG ATATCGCCGTGGAGTGGGAGTCCAACGGCCAGCCCGAGAACAAC TACAAGACCACCCCTCCCGTGCTGGACTCCGACGGCTCCTTCTT CCTGTACTCTCGGCTGACCGTGGACAAGTCCCGGTGGCAGGAAG GCAACGTCTTCTCCTGCTCCGTGATGCACGAGGCCCTGCACAAC CACTACACCCAGAAGTCCCTGTCCCTGTCTCTGGGC |

SRF386-A

| SEQ ID NO | Description | Sequence |
|---|---|---|
| 139 | HCDR1 (IMGT) | GFTFASYG |
| 140 | HCDR2 (IMGT) | ISSSSSYI |
| 141 | HCDR3 (IMGT) | ARDGGRTSYTATAHNWFDP |
| 142 | HCDR1 (NT) | FTFASYGMN |
| 143 | HCDR2 (NT) | SISSSSSYIYYADSVKG |
| 144 | HCDR3 (NT) | ARDGGRTSYTATAHNWFDP |
| 145 | VH | EVQLVESGGGLVKPGGSLRLSCAASGFTFASYGMNWVRQAPGKG LEWVSSISSSSSYIYYADSVKGRFTISRDNAKNSLYLQMNSLRA EDTAVYYCARDGGRTSYTATAHNWFDPWGQGTLVTVSS |
| 146 | DNA VH | GAGGTGCAGCTGGTGGAGTCTGGGGGAGGCCTGGTCAAGCCTGG GGGGTCCCTGAGACTCTCCTGTGCAGCCTCTGGATTCACCTTCG CTAGCTATGGGATGAACTGGGTCCGCCAGGCTCCAGGGAAGGGG CTGGAGTGGGTCTCATCCATTAGTAGTTCTAGTAGTTACATATA CTACGCAGACTCAGTGAAGGGCCGATTCACCATCTCCAGAGACA ACGCCAAGAACTCACTGTATCTGCAAATGAACAGCCTGAGAGCC GAGGACACGGCGGTGTACTACTGCGCCAGAGATGGTGGAAGAAC GTCCTACACCGCCACAGCCCACAATTGGTTCGACCCCTGGGGAC AGGGTACATTGGTCACCGTCTCCTCA |
| 147 | LCDR1 (IMGT) | QSVLFSSNNKNY |
| 148 | LCDR2 (IMGT) | WAS |
| 149 | LCDR3 (IMGT) | QQHASAPPT |
| 150 | LCDR1 (NT) | KSSQSVLFSSNNKNYLA |
| 151 | LCDR2 (NT) | WASTRES |
| 152 | LCDR3 (NT) | QQHASAPPT |
| 153 | VL | DIVMTQSPDSLAVSLGERATINCKSSQSVLFSSNNKNYLAWYQQ KPGQPPKLLIYWASTRESGVPDRFSGSGSGTDFTLTISSLQAED VAVYYCQQHASAPPTFGGGTKVEIK |
| 154 | DNA VL | GACATCGTGATGACCCAGTCTCCAGACTCCCTGGCTGTGTCTCT GGGCGAGAGGGCCACCATCAACTGCAAGTCCAGCCAGAGTGTTT TATTCAGCTCCAACAATAAGAACTACTTAGCTTGGTACCAGCAG AAACCAGGACAGCCTCCTAAGCTGCTCATTTACTGGGCATCTAC CCGGGAATCCGGGGTCCCTGACCGATTCAGTGGCAGCGGGTCTG GGACAGATTTCACTCTCACCATCAGCAGCCTGCAGGCTGAAGAT GTGGCAGTTTATTACTGTCAGCAGCACGCCAGTGCCCCTCCTAC TTTTGGCGGAGGGACCAAGGTTGAGATCAAA |
| 155 | Heavy Chain | EVQLVESGGGLVKPGGSLRLSCAASGFTFASYGMNWVRQAPGKG LEWVSSISSSSSYIYYADSVKGRFTISRDNAKNSLYLQMNSLRA EDTAVYYCARDGGRTSYTATAHNWFDPWGQGTLVTVSSASTKGP SVFPLAPSSKSTSGGTAALGCLVKDYFPEPVTVSWNSGALTSGV HTFPAVLQSSGLYSLSSVVTVPSSSLGTQTYICNVNHKPSNTKV DKKVEPKSCDKTHTCPPCPAPELLGGPSVFLFPPKPKDTLMISR TPEVTCVVVDVSHEDPEVKFNWYVDGVEVHNAKTKPREEQYNST YRVVSVLTVLHQDWLNGKEYKCKVSNKALPAPIEKTISKAKGQP REPQVYTLPPSRDELTKNQVSLTCLVKGFYPSDIAVEWESNGQP ENNYKTTPPVLDSDGSFFLYSKLTVDKSRWQQGNVFSCSVMHEA LHNHYTQKSLSLSPGK |
| 156 | DNA Heavy Chain | GAGGTGCAGCTGGTGGAGTCTGGGGGAGGCCTGGTCAAGCCTGG GGGGTCCCTGAGACTCTCCTGTGCAGCCTCTGGATTCACCTTCG CTAGCTATGGGATGAACTGGGTCCGCCAGGCTCCAGGGAAGGGG CTGGAGTGGGTCTCATCCATTAGTAGTTCTAGTAGTTACATATA CTACGCAGACTCAGTGAAGGGCCGATTCACCATCTCCAGAGACA ACGCCAAGAACTCACTGTATCTGCAAATGAACAGCCTGAGAGCC GAGGACACGGCGGTGTACTACTGCGCCAGAGATGGTGGAAGAAC GTCCTACACCGCCACAGCCCACAATTGGTTCGACCCCTGGGGAC AGGGTACATTGGTCACCGTCTCCTCAGCGAGCACCAAGGGCCCG AGCGTGTTTCCGCTGGCGCCAGCAGCAAAAGCACCAGCGGCGG CACCGCGGCGCTGGGCTGCCTGGTGAAAGATTATTTTCCGGAAC |

TABLE 12-continued

SEQUENCE LISTING

| SEQ ID NO | Description | Sequence |
|---|---|---|
| | | CGGTGACCGTGAGCTGGAACAGCGGCGCGCTGACCAGCGGCGTG<br>CATACCTTTCCGGCGGTGCTGCAGAGCAGCGGCCTGTATAGCCT<br>GAGCAGCGTGGTGACCGTGCCGAGCAGCAGCCTGGGCACCCAGA<br>CCTATATTTGCAACGTGAACCATAAACCGAGCAACACCAAAGTG<br>GATAAAAAAGTGGAACCGAAAAGCTGCGATAAAACCCATACCTG<br>CCCGCCGTGCCCGGCGCCGGAACTGCTGGGCGGCCCGAGCGTGT<br>TTCTGTTTCCGCCGAAACCGAAAGATACCCTGATGATTAGCCGC<br>ACCCCGGAAGTGACCTGCGTGGTGGATGTGAGCCATGAAGA<br>TCCGGAAGTGAAATTTAACTGGTATGTGGATGGCGTGGAAGTGC<br>ATAACGCGAAAACCAAACCGCGCGAAGAACAGTATAACAGCACC<br>TATCGCGTGGTGAGCGTGCTGACCGTGCTGCATCAGGATTGGCT<br>GAACGGCAAAGAATATAAATGCAAAGTGAGCAACAAAGCGCTGC<br>CGGCGCCGATTGAAAAAACCATTAGCAAAGCGAAAGGCCAGCCG<br>CGCGAACCGCAGGTGTATACCCTGCCGCCGAGCCGCGATGAACT<br>GACCAAAAACCAGGTGAGCCTGACCTGCCTGGTGAAAGGCTTTT<br>ATCCGAGCGATATTGCGGTGGAATGGGAAAGCAACGGCCAGCCG<br>GAAAACAACTATAAAACCACCCCGCCGGTGCTGGATAGCGATGG<br>CAGCTTTTTTCTGTATAGCAAACTGACCGTGGATAAAAGCCGCT<br>GGCAGCAGGGCAACGTGTTTAGCTGCAGCGTGATGCATGAAGCG<br>CTGCATAACCATTATACCCAGAAAAGCCTGAGCCTGAGCCCGGG<br>CAAA |
| 157 | Light Chain | DIVMTQSPDSLAVSLGERATINCKSSQSVLFSSNNKNYLAWYQQ<br>KPGQPPKLLIYWASTRESGVPDRFSGSGSGTDFTLTISSLQAED<br>VAVYYCQQHASAPPTFGGGTKVEIKRTVAAPSVFIFPPSDEQLK<br>SGTASVVCLLNNFYPREAKVQWKVDNALQSGNSQESVTEQDSKD<br>STYSLSSTLTLSKADYEKHKVYACEVTHQGLSSPVTKSFNRGEC |
| 158 | DNA Light Chain | GACATCGTGATGACCCAGTCTCCAGACTCCCTGGCTGTGTCTCT<br>GGGCGAGAGGGCCACCATCAACTGCAAGTCCAGCCAGAGTGTT<br>TATTCAGCTCCAACAATAAGAACTACTTAGCTTGGTACCAGCAG<br>AAACCAGGACAGCCTCCTAAGCTGCTCATTTACTGGGCATCTAC<br>CCGGGAATCCGGGGTCCCTGACCGATTCAGTGGCAGCGGGTCTG<br>GGACAGATTTCACTCTCACCATCAGCAGCCTGCAGGCTGAAGAT<br>GTGGCAGTTTATTACTGTCAGCAGCACGCCAGTGCCCCTCCTAC<br>TTTTGGCGGAGGGACCAAGGTTGAGATCAAACGTACGGTGGCCG<br>CTCCCTCCGTGTTCATCTTCCCACCCTCCGACGAGCAGCTGAAG<br>TCCGGCACCGCCTCCGTCGTGTGCCTGCTGAACAACTTCTACCC<br>TCGCGAGGCCAAAGTCAGTGGAAAGTGGACAACGCCCTGCAGT<br>CCGGCAACTCCCAGGAATCCGTCACCGAGCAGGACTCCAAGGAC<br>AGCACCTACTCCCTGTCCTCCACCCTGACCCTGTCCAAGGCCGA<br>CTACGAGAAGCACAAAGTGTACGCCTGCGAAGTGACCCACCAGG<br>GCCTGTCCAGCCCCGTGACCAAGTCCTTCAACCGGGGCGAGTGC |

SRF386-B

| 159 | Heavy Chain | EVQLVESGGGLVKPGGSLRLSCAASGFTFASYGMNWVRQAPGKG<br>LEWVSSISSSSSYIYYADSVKGRFTISRDNAKNSLYLQMNSLRA<br>EDTAVYYCARDGGRTSYTATAHNWFDPWGQGTLVTVSSASTKGP<br>SVFPLAPCSRSTSESTAALGCLVKDYFPEPVTVSWNSGALTSGV<br>HTFPAVLQSSGLYSLSSVVTVPSSSLGTKTYTCNVDHKPSNTKV<br>DKRVESKYGPPCPSCPAPEFLGGPSVFLFPPKPKDTLMISRTPE<br>VTCVVVDVSQEDPEVQFNWYVDGVEVHNAKTKPREEQFNSTYRV<br>VSVLTVLHQDWLNGKEYKCKVSNKGLPSSIEKTISKAKGQPREP<br>QVYTLPPSQEEMTKNQVSLTCLVKGFYPSDIAVEWESNGQPENN<br>YKTTPPVLDSDGSFFLYSRLTVDKSRWQEGNVFSCSVMHEALHN<br>HYTQKSLSLSLG |
| --- | --- | --- |
| 160 | DNA Heavy Chain | GAGGTGCAGCTGGTGGAGTCTGGGGGAGGCCTGGTCAAGCCTGG<br>GGGGTCCCTGAGACTCTCCTGTGCAGCCTCTGGATTCACCTTCG<br>CTAGCTATGGGATGAACTGGGTCCGCCAGGCTCCAGGGAAGGGG<br>CTGGAGTGGGTCTCATCCATTAGTAGTTCTAGTAGTTACATATA<br>CTACGCAGACTCAGTGAAGGGCCGATTCACCATCTCCAGAGACA<br>ACGCCAAGAACTCACTGTATCTGCAAATGAACAGCCTGAGAGCC<br>GAGGACACGGCGGTGTACTACTGCGCCAGAGATGGTGGAAGAAC<br>GTCCTACACCGCCACAGCCCACAATTGGTTCGACCCCTGGGGAC<br>AGGGTACATTGGTCACCGTCCTCAGCTTCCACCAAGGGCCCC<br>TCCGTGTTCCCTCTGGCCCCTTGCTCCCGGTCCACCTCCGAGTC<br>TACCGCCGCTCTGGGCTGCCTCGTGAAGGACTACTTCCCCGAGC<br>CCGTGACCGTGTCCTGGAACTCTGGCGCCCTGACCTCCGGCGTG<br>CACACCTTCCCTGCCGTGCTGCAGTCCTCCGGCCTGTACTCCCT<br>GTCCAGCGTCGTGACCGTGCCCTCCTCCAGCCTGGGCACCAAGA<br>CCTACACCTGTAACGTGGACCACAAGCCCTCCAACACCAAAGTG<br>GACAAGCGGGTGGAATCTAAGTACGCCCTCCCTGCCCTTCCTG<br>CCCTGCCCCTGAGTTCCTGGGCGGACCTTCCGTGTTCCTGTTCC<br>CTCCAAAGCCCAAGGACACCCTGATGATCTCCCGGACCCCTGAA<br>GTGACCTGCGTGGTGGTGGACGTGTCCCAGGAAGATCCCGAAGT<br>CCAGTTCAATTGGTACGTGGACGGCGTGGAAGTGCACAACGCCA |

TABLE 12-continued

SEQUENCE LISTING

| SEQ ID NO | Description | Sequence |
|---|---|---|
| | | AGACCAAGCCCAGAGAGGAACAGTTCAACTCCACCTACCGGGTG<br>GTGTCCGTGCTGACCGTGCTGCACCAGGACTGGCTGAACGGCAA<br>AGAGTACAAGTGCAAAGTGTCCAACAAGGGCCTGCCCTCCAGCA<br>TCGAAAAGACCATCTCCAAGGCCAAGGGCCAGCCCCGCGAGCCC<br>CAAGTGTACACCCTGCCTCCCAGCCAGGAAGAGATGACCAAGAA<br>TCAAGTGTCCCTGACTTGTCTGGTCAAGGGCTTCTACCCCTCCG<br>ATATCGCCGTGGAGTGGGAGTCCAACGGCCAGCCCGAGAACAAC<br>TACAAGACCACCCCTCCCGTGCTGGACTCCGACGGCTCCTTCTT<br>CCTGTACTCTCGGCTGACCGTGGACAAGTCCCGGTGGCAGGAAG<br>GCAACGTCTTCTCCTGCTCCGTGATGCACGAGGCCCTGCACAAC<br>CACTACACCCAGAAGTCCCTGTCCCTGTCTCTGGGC |

SRF388-A

| SEQ ID NO | Description | Sequence |
|---|---|---|
| 161 | HCDR1 (IMGT) | GFTFRSYG |
| 162 | HCDR2 (IMGT) | ISSSGSYI |
| 163 | HCDR3 (IMGT) | ARDGGRTSYTATAHNWFDP |
| 164 | HCDR1 (NT) | FTFRSYGMN |
| 165 | HCDR2 (NT) | GISSSGSYIYYADSVKG |
| 166 | HCDR3 (NT) | ARDGGRTSYTATAHNWFDP |
| 167 | VH | EVQLVESGGGLVKPGGSLRLSCAASGFTFRSYGMNWVRQAPGKG<br>LEWVSGISSSGSYIYYADSVKGRFTISRDNAKNSLYLQMNSLRA<br>EDTAVYYCARDGGRTSYTATAHNWFDPWGQGTLVTVSS |
| 168 | DNA VH | GAGGTGCAGCTGGTGGAGTCTGGGGGAGGCCTGGTCAAGCCTGG<br>GGGGTCCCTGAGACTCTCCTGTGCAGCCTCTGGATTCACCTTCC<br>GTAGCTATGGGATGAACTGGGTCCGCCAGGCTCCAGGGAAGGGG<br>CTGGAGTGGGTCTCAGGTATTAGTAGTAGTGGTAGTTACATATA<br>CTACGCAGACTCAGTGAAGGGCCGATTCACCATCTCCAGAGACA<br>ACGCCAAGAACTCACTGTATCTGCAAATGAACAGCCTGAGAGCC<br>GAGGACACGGCGGTGTACTACTGCGCCAGAGATGGTGGAAGAAC<br>GTCCTACACCGCCACAGCCCACAATTGGTTCGACCCCTGGGGAC<br>AGGGTACATTGGTCACCGTCTCCTCA |
| 169 | LCDR1 (IMGT) | QSVLFSSNNKNY |
| 170 | LCDR2 (IMGT) | WAS |
| 171 | LCDR3 (IMGT) | QQHASAPPT |
| 172 | LCDR1 (NT) | KSSQSVLFSSNNKNYLA |
| 173 | LCDR2 (NT) | WASTRES |
| 174 | LCDR3 (NT) | QQHASAPPT |
| 175 | VL | DIVMTQSPDSLAVSLGERATINCKSSQSVLFSSNNKNYLAWYQQ<br>KPGQPPKLLIYWASTRESGVPDRFSGSGSGTDFTLTISSLQAED<br>VAVYYCQQHASAPPTFGGGTKVEIK |
| 176 | DNA VL | GACATCGTGATGACCCAGTCTCCAGACTCCCTGGCTGTGTCTCT<br>GGGCGAGAGGGCCACCATCAACTGCAAGTCCAGCCAGAGTGTTT<br>TATTCAGCTCCAACAATAAGAACTACTTAGCTTGGTACCAGCAG<br>AAACCAGGACAGCCTCCTAAGCTGCTCATTTACTGGGCATCTAC<br>CCGGGAATCCGGGGTCCCTGACCGATTCAGTGGCAGCGGGTCTG<br>GGACAGATTTCACTCTCACCATCAGCAGCCTGCAGGCTGAAGAT<br>GTGGCAGTTTATTACTGTCAGCAGCACGCCAGTGCCCCTCCTAC<br>TTTTGGCGGAGGGACCAAGGTTGAGATCAAA |
| 177 | Heavy Chain | EVQLVESGGGLVKPGGSLRLSCAASGFTFRSYGMNWVRQAPGKG<br>LEWVSGISSSGSYIYYADSVKGRFTISRDNAKNSLYLQMNSLRA<br>EDTAVYYCARDGGRTSYTATAHNWFDPWGQGTLVTVSSASTKGP<br>SVFPLAPSSKSTSGGTAALGCLVKDYFPEPVTVSWNSGALTSGV<br>HTFPAVLQSSGLYSLSSVVTVPSSSLGTQTYICNVNHKPSNTKV<br>DKKVEPKSCDKTHTCPPCPAPELLGGPSVFLFPPKPKDTLMISR<br>TPEVTCVVVDVSHEDPEVKFNWYVDGVEVHNAKTKPREEQYNST<br>YRVVSVLTVLHQDWLNGKEYKCKVSNKALPAPIEKTISKAKGQP<br>REPQVYTLPPSRDELTKNQVSLTCLVKGFYPSDIAVEWESNGQP<br>ENNYKTTPPVLDSDGSFFLYSKLTVDKSRWQQGNVFSCSVMHEA<br>LHNHYTQKSLSLSPGK |
| 178 | DNA Heavy Chain | GAGGTGCAGCTGGTGGAGTCTGGGGGAGGCCTGGTCAAGCCTGG<br>GGGGTCCCTGAGACTCTCCTGTGCAGCCTCTGGATTCACCTTCC<br>GTAGCTATGGGATGAACTGGGTCCGCCAGGCTCCAGGGAAGGGG<br>CTGGAGTGGGTCTCAGGTATTAGTAGTAGTGGTAGTTACATATA<br>CTACGCAGACTCAGTGAAGGGCCGATTCACCATCTCCAGAGACA<br>ACGCCAAGAACTCACTGTATCTGCAAATGAACAGCCTGAGAGCC<br>GAGGACACGGCGGTGTACTACTGCGCCAGAGATGGTGGAAGAAC<br>GTCCTACACCGCCACAGCCCACAATTGGTTCGACCCCTGGGGAC<br>AGGGTACATTGGTCACCGTCTCCTCAGCGAGCACCAAAGGCCCG |

TABLE 12-continued

SEQUENCE LISTING

| SEQ ID NO | Description | Sequence |
|---|---|---|
| | | AGCGTGTTTCCGCTGGCGCCGAGCAGCAAAAGCACCAGCGGCGG
CACCGCGGCGCTGGGCTGCCTGGTGAAAGATTATTTTCCGGAAC
CGGTGACCGTGAGCTGGAACAGCGGCGCGCTGACCAGCGGCGTG
CATACCTTTCCGGCGGTGCTGCAGAGCAGCGGCCTGTATAGCCT
GAGCAGCGTGGTGACCGTGCCGAGCAGCAGCCTGGGCACCCAGA
CCTATATTTGCAACGTGAACCATAAACCGAGCAACACCAAAGTG
GATAAAAAAGTGGAACCGAAAAGCTGCGATAAAACCCATACCTG
CCCGCCGTGCCCGGCGCCGGAACTGCTGGGCGGCCCGAGCGTGT
TTCTGTTTCCGCCGAAACCGAAAGATACCCTGATGATTAGCCGC
ACCCCGGAAGTGACCTGCGTGGTGGTGGATGTGAGCCATGAAGA
TCCGGAAGTGAAATTTAACTGGTATGTGGATGGCGTGGAAGTGC
ATAACGCGAAAACCAAACCGCGCGAAGAACAGTATAACAGCACC
TATCGCGTGGTGAGCGTGCTGACCGTGCTGCATCAGGATTGGCT
GAACGGCAAAGAATATAAATGCAAAGTGAGCAACAAAGCGCTGC
CGGCGCCGATTGAAAAAACCATTAGCAAAGCGAAAGGCCAGCCG
CGCGAACCGCAGGTGTATACCCTGCCGCCGAGCCGCGATGAACT
GACCAAAAACCAGGTGAGCCTGACCTGCCTGGTGAAAGGCTTTT
ATCCGAGCGATATTGCGGTGGAATGGGAAAGCAACGGCCAGCCG
GAAAACAACTATAAAACCACCCCGCCGGTGCTGGATAGCGATGG
CAGCTTTTTTCTGTATAGCAAACTGACCGTGGATAAAAGCCGCT
GGCAGCAGGGCAACGTGTTTAGCTGCAGCGTGATGCATGAAGCG
CTGCATAACCATTATACCCAGAAAAGCCTGAGCCTGAGCCCGGG
CAAA |
| 179 | Light Chain | DIVMTQSPDSLAVSLGERATINCKSSQSVLFSSNNKNYLAWYQQ
KPGQPPKLLIYWASTRESGVPDRFSGSGSGTDFTLTISSLQAED
VAVYYCQQHASAPPTFGGGTKVEIKRTVAAPSVFIFPPSDEQLK
SGTASVVCLLNNFYPREAKVQWKVDNALQSGNSQESVTEQDSKD
STYSLSSTLTLSKADYEKHKVYACEVTHQGLSSPVTKSFNRGEC |
| 180 | DNA Light Chain | GACATCGTGATGACCCAGTCTCCAGACTCCCTGGCTGTGTCTCT
GGGCGAGAGGGCCACCATCAACTGCAAGTCCAGCCAGAGTGTTT
TATTCAGCTCCAACAATAAGAACTACTTAGCTTGGTACCAGCAG
AAACCAGGACAGCCTCCTAAGCTGCTCATTTACTGGGCATCTAC
CCGGGAATCCGGGGTCCCTGACCGATTCAGTGGCAGCGGGTCTG
GGACAGATTTCACTCTCACCATCAGCAGCCTGCAGGCTGAAGAT
GTGGCAGTTTATTACTGTCAGCAGCACGCCAGTGCCCCTCCTAC
TTTTGGCGGAGGGACCAAGGTTGAGATCAAACGTACGGTGGCCG
CTCCCTCCGTGTTCATCTTCCCACCCTCCGACGAGCAGCTGAAG
TCCGGCACCGCCTCCGTCGTGTGCCTGCTGAACAACTTCTACCC
TCGCGAGGCCAAAGTGCAGTGGAAAGTGGACAACGCCCTGCAGT
CCGGCAACTCCCAGGAATCCGTCACCGAGCAGGACTCCAAGGAC
AGCACCTACTCCCTGTCCTCCACCCTGACCCTGTCCAAGGCCGA
CTACGAGAAGCACAAAGTGTACGCCTGCGAAGTGACCCACCAGG
GCCTGTCCAGCCCCGTGACCAAGTCCTTCAACGGGGCGAGTGC |

SRF388-B

| 181 | Heavy Chain | EVQLVESGGGLVKPGGSLRLSCAASGFTFRSYGMNWVRQAPGKG
LEWVSGISSSGSYIYYADSVKGRFTISRDNAKNSLYLQMNSLRA
EDTAVYYCARDGGRTSYTATAHNWFDPWGQGTLVTVSSASTKGP
SVFPLAPCSRSTSESTAALGCLVKDYFPEPVTVSWNSGALTSGV
HTFPAVLQSSGLYSLSSVVTVPSSSLGTKTYTCNVDHKPSNTKV
DKRVESKYGPPCPSCPAPEFLGGPSVFLFPPKPKDTLMISRTPE
VTCVVVDVSQEDPEVQFNWYVDGVEVHNAKTKPREEQFNSTYRV
VSVLTVLHQDWLNGKEYKCKVSNKGLPSSIEKTISKAKGQPREP
QVYTLPPSQEEMTKNQVSLTCLVKGFYPSDIAVEWESNGQPENN
YKTTPPVLDSDGSFFLYSRLTVDKSRWQEGNVFSCSVMHEALHN
HYTQKSLSLSLG |
| 182 | DNA Heavy Chain | GAGGTGCAGCTGGTGGAGTCTGGGGGAGGCCTGGTCAAGCCTGG
GGGGTCCCTGAGACTCTCCTGTGCAGCCTCTGGATTCACCTTCC
GTAGCTATGGGATGAACTGGGTCCGCCAGGCTCCAGGGAAGGGG
CTGGAGTGGGTCTCAGGTATTAGTAGTAGTGGTAGTTACATATA
CTACGCAGACTCAGTGAAGGGCCGATTCACCATCTCCAGAGACA
ACGCCAAGAACTCACTGTATCTGCAAATGAACAGCCTGAGAGCC
GAGGACACGGCGGTGTACTACTGCGCCAGAGATGGTGGAAGAAC
GTCCTACACCGCCACAGCCCACAATTGGTTCGACCCCTGGGGAC
AGGGTACATTGGTCACCGTCTCCTCAGCTTCACCAAGGGCCCC
TCCGTGTTCCCTCTGGCCCCTTGCTCCCGGTCCACCTCCGAGTC
TACCGCCGCTCTGGGCTGCCTCGTGAAGGACTACTTCCCCGAGC
CCGTGACCGTGTCCTGGAACTCTGGCGCCCTGACCTCCGGCGTG
CACACCTTCCCTGCCGTGCTGCAGTCCTCCGGCCTGTACTCCCT
GTCCAGCGTCGTGACCGTGCCCTCCTCCAGCCTGGGCACCAAGA
CCTACACCTGTAACGTGGACCACAAGCCCTCCAACACCAAAGTG
GACAAGCGGGTGGAATCTAAGTACGGCCCTCCCTGCCCTTCCTG
CCCTGCCCCTGAGTTCCTGGGCGGACCTTCCGTGTTCCTGTTCC
CTCCAAAGCCCAAGGACACCCTGATGATCTCCCGGACCCCTGAA |

TABLE 12-continued

SEQUENCE LISTING

| SEQ ID NO | Description | Sequence |
|---|---|---|
| | | GTGACCTGCGTGGTGGTGGACGTGTCCCAGGAAGATCCCGAAGT |
| | | CCAGTTCAATTGGTACGTGGACGGCGTGGAAGTGCACAACGCCA |
| | | AGACCAAGCCCAGAGAGGAACAGTTCAACTCCACCTACCGGGTG |
| | | GTGTCCGTGCTGACCGTGCTGCACCAGGACTGGCTGAACGGCAA |
| | | AGAGTACAAGTGCAAAGTGTCCAACAAGGGCCTGCCCTCCAGCA |
| | | TCGAAAAGACCATCTCCAAGGCCAAGGGCCAGCCCCGCGAGCCC |
| | | CAAGTGTACACCCTGCCTCCCAGCCAGGAAGAGATGACCAAGAA |
| | | TCAAGTGTCCCTGACTTGTCTGGTCAAGGGCTTCTACCCCTCCG |
| | | ATATCGCCGTGGAGTGGGAGTCCAACGGCCAGCCCGAGAACAAC |
| | | TACAAGACCACCCCTCCCGTGCTGGACTCCGACGGCTCCTTCTT |
| | | CCTGTACTCTCGGCTGACCGTGGACAAGTCCCGGTGGCAGGAAG |
| | | GCAACGTCTTCTCCTGCTCCGTGATGCACGAGGCCCTGCACAAC |
| | | CACTACACCCAGAAGTCCCTGTCCCTGTCTCTGGGC |

SRF410-A

| 185 | HCDR1 (IMGT) | GGTFSAYA |
| 186 | HCDR2 (IMGT) | IIPIFGTA |
| 187 | HCDR3 (IMGT) | ARSYYSSRWHYYYYMDV |
| 188 | HCDR1 (NT) | GTFSAYAIS |
| 189 | HCDR2 (NT) | GIIPIFGTANYAQKFQG |
| 190 | HCDR3 (NT) | ARSYYSSRWHYYYYMDV |
| 191 | VH | QVQLVQSGAEVKKPGSSVKVSCKASGGTFSAYAISWVRQAPGQG |
| | | LEWMGGIIPIFGTANYAQKFQGRVTITADESTSTAYMELSSLRS |
| | | EDTAVYYCARSYYSSRWHYYYYMDVWGKGTTVTVSS |
| 192 | DNA VH | CAGGTGCAGCTGGTGCAGTCTGGGGCTGAGGTGAAGAAGCCTGG |
| | | GTCCTCGGTGAAGGTCTCCTGCAAGGCTTCTGGAGGCACCTTCA |
| | | GCGCTTATGCGATCAGCTGGGTGCGACAGGCCCCTGGACAAGGG |
| | | CTTGAGTGGATGGGAGGGATCATCCCTATCTTTGGTACAGCAAA |
| | | CTACGCACAGAAGTTCCAGGGCAGAGTCACGATTACCGCGGACG |
| | | AATCCACGAGCACAGCCTACATGGAGCTGAGCAGCCTGAGATCT |
| | | GAGGACACGGCGGTGTACTACTGCGCCAGATCTTACTACTCCAG |
| | | CCGATGGCACTACTACTACTACATGGACGTGTGGGGCAAGGGTA |
| | | CAACTGTCACCGTCTCCTCA |
| 193 | LCDR1 (IMGT) | QGISSW |
| 194 | LCDR2 (IMGT) | AAS |
| 195 | LCDR3 (IMGT) | QQADDLPLT |
| 196 | LCDR1 (NT) | RASQGISSWLA |
| 197 | LCDR2 (NT) | AASNLQS |
| 198 | LCDR3 (NT) | QQADDLPLT |
| 199 | VL | DIQMTQSPSSVSASVGDRVTITCRASQGISSWLAWYQQKPGKAP |
| | | KLLIYAASNLQSGVPSRFSGSGSGTDFTLTISSLQPEDFATYYC |
| | | QQADDLPLTFGGGTKVEIK |
| 200 | DNA VL | GACATCCAGATGACACAGTCTCCATCTTCCGTGTCTGCATCTGT |
| | | AGGAGACAGAGTCACCATCACTTGTCGGGCGAGTCAGGGTATTA |
| | | GCAGCTGGTTAGCCTGGTATCAGCAGAAACCAGGGAAAGCCCCT |
| | | AAGCTCCTGATCTATGCTGCATCCAATTTGCAAAGTGGGGTCCC |
| | | ATCAAGGTTCAGCGGCAGTGGATCTGGGACAGATTTCACTCTCA |
| | | CCATCAGCAGCCTGCAGCCTGAAGATTTTGCAACTTATTACTGT |
| | | CAGCAGGCAGACGACCTCCCTCTCACTTTTGGCGGAGGGACCAA |
| | | GGTTGAGATCAAA |
| 201 | Heavy Chain | QVQLVQSGAEVKKPGSSVKVSCKASGGTFSAYAISWVRQAPGQG |
| | | LEWMGGIIPIFGTANYAQKFQGRVTITADESTSTAYMELSSLRS |
| | | EDTAVYYCARSYYSSRWHYYYYMDVWGKGTTVTVSSASTKGPSV |
| | | FPLAPSSKSTSGGTAALGCLVKDYFPEPVTVSWNSGALTSGVHT |
| | | FPAVLQSSGLYSLSSVVTVPSSSLGTQTYICNVNHKPSNTKVDK |
| | | KVEPKSCDKTHTCPPCPAPELLGGPSVFLFPPKPKDTLMISRTP |
| | | EVTCVVVDVSHEDPEVKFNWYVDGVEVHNAKTKPREEQYNSTYR |
| | | VVSVLTVLHQDWLNGKEYKCKVSNKALPAPIEKTISKAKGQPRE |
| | | PQVYTLPPSRDELTKNQVSLTCLVKGFYPSDIAVEWESNGQPEN |
| | | NYKTTPPVLDSDGSFFLYSKLTVDKSRWQQGNVFSCSVMHEALH |
| | | NHYTQKSLSLSPGK |
| 202 | DNA Heavy Chain | CAGGTGCAGCTGGTGCAGTCTGGGGCTGAGGTGAAGAAGCCTGG |
| | | GTCCTCGGTGAAGGTCTCCTGCAAGGCTTCTGGAGGCACCTTCA |
| | | GCGCTTATGCGATCAGCTGGGTGCGACAGGCCCCTGGACAAGGG |
| | | CTTGAGTGGATGGGAGGGATCATCCCTATCTTTGGTACAGCAAA |
| | | CTACGCACAGAAGTTCCAGGGCAGAGTCACGATTACCGCGGACG |
| | | AATCCACGAGCACAGCCTACATGGAGCTGAGCAGCCTGAGATCT |
| | | GAGGACACGGCGGTGTACTACTGCGCCAGATCTTACTACTCCAG |

TABLE 12-continued

SEQUENCE LISTING

| SEQ ID NO | Description | Sequence |
|---|---|---|
| | | CCGATGGCACTACTACTACTACATGGACGTGTGGGGCAAGGGTA<br>CAACTGTCACCGTCTCCTCAGCGAGCACCAAAGGCCCGAGCGTG<br>TTTCCGCTGGCGCCGAGCAGCAAAAGCACCAGCGGCGGCACCGC<br>GGCGCTGGGCTGCCTGGTGAAAGATTATTTTCCGGAACCGGTGA<br>CCGTGAGCTGGAACAGCGGCGCGCTGACCAGCGGCGTGCATACC<br>TTTCCGGCGGTGCTGCAGAGCAGCGGCCTGTATAGCCTGAGCAG<br>CGTGGTGACCGTGCCGAGCAGCAGCCTGGGCACCCAGACCTATA<br>TTTGCAACGTGAACCATAAACCGAGCAACACCAAAGTGGATAAA<br>AAAGTGGAACCGAAAAGCTGCGATAAACCCATACCTGCCCGCC<br>GTGCCCGGCGCCGGAACTGCTGGGCGGCCCGAGCGTGTTTCTGT<br>TTCCGCCGAAACCGAAAGATACCCTGATGATTAGCCGCACCCCG<br>GAAGTGACCTGCGTGGTGGTGGATGTGAGCCATGAAGATCCGGA<br>AGTGAAATTTAACTGGTATGTGGATGGCGTGGAAGTGCATAACG<br>CGAAAACCAAACCGCGCGAAGAACAGTATAACAGCACCTATCGC<br>GTGGTGAGCGTGCTGACCGTGCTGCATCAGGATTGGCTGAACGG<br>CAAAGAATATAAATGCAAAGTGAGCAACAAAGCGCTGCCGGCGC<br>CGATTGAAAAAACCATTAGCAAAGCGAAAGGCCAGCCGCGCGAA<br>CCGCAGGTGTATACCCTGCCGCCGAGCCGCGATGAACTGACCAA<br>AAACCAGGTGAGCCTGACCTGCCTGGTGAAAGGCTTTTATCCGA<br>GCGATATTGCGGTGGAATGGGAAAGCAACGGCCAGCCGGAAAAC<br>AACTATAAAACCACCCCGCCGGTGCTGGATAGCGATGGCAGCTT<br>TTTTCTGTATAGCAAACTGACCGTGGATAAAAGCCGCTGGCAGC<br>AGGGCAACGTGTTTAGCTGCAGCGTGATGCATGAAGCGCTGCAT<br>AACCATTATACCCAGAAAAGCCTGAGCCTGAGCCCGGGCAAA |
| 203 | Light Chain | DIQMTQSPSSVSASVGDRVTITCRASQGISSWLAWYQQKPGKAP<br>KLLIYAASNLQSGVPSRFSGSGSGTDFTLTISSLQPEDFATYYC<br>QQADDLPLTFGGGTKVEIKRTVAAPSVFIFPPSDEQLKSGTASV<br>VCLLNNFYPREAKVQWKVDNALQSGNSQESVTEQDSKDSTYSLS<br>STLTLSKADYEKHKVYACEVTHQGLSSPVTKSFNRGEC |
| 204 | DNA Light Chain | GACATCCAGATGACACAGTCTCCATCTTCCGTGTCTGCATCTGT<br>AGGAGACAGAGTCACCATCACTTGTCGGGCGAGTCAGGGTATTA<br>GCAGCTGGTTAGCCTGGTATCAGCAGAAACCAGGGAAAGCCCCT<br>AAGCTCCTGATCTATGCTGCATCCAATTTGCAAAGTGGGGTCCC<br>ATCAAGGTTCAGCGGCAGTGGATCTGGGACAGATTTCACTCTCA<br>CCATCAGCAGCCTGCAGCCTGAAGATTTTGCAACTTATTACTGT<br>CAGCAGGCAGACGACCTCCCTCTCACTTTTGGCGGAGGGACCAA<br>GGTTGAGATCAAACGTACGGTGGCCGCTCCCTCCGTGTTCATCT<br>TCCCACCCTCCGACGAGCAGCTGAAGTCCGGCACCGCCTCCGTC<br>GTGTGCCTGCTGAACAACTTCTACCCTCGCGAGGCCAAAGTGCA<br>GTGGAAAGTGGACAACGCCCTGCAGTCCGGCAACTCCCAGGAAT<br>CCGTCACCGAGCAGGACTCCAAGGACAGCACCTACTCCCTGTCC<br>TCCACCCTGACCCTGTCCAAGGCCGACTACGAGAAGCACAAAGT<br>GTACGCCTGCGAAGTGACCCACCAGGGCCTGTCCAGCCCCGTGA<br>CCAAGTCCTTCAACCGGGGCGAGTGC |

SRF410-B

| SEQ ID NO | Description | Sequence |
|---|---|---|
| 205 | Heavy Chain | QVQLVQSGAEVKKPGSSVKVSCKASGGTFSAYAISWVRQAPGQG<br>LEWMGGIIPIFGTANYAQKFQGRVTITADESTSTAYMELSSLRS<br>EDTAVYYCARSYYSSRWHYYYYMDVWGKGTTVTVSSASTKGPSV<br>FPLAPCSRSTSESTAALGCLVKDYFPEPVTVSWNSGALTSGVHT<br>FPAVLQSSGLYSLSSVVTVPSSSLGTKTYTCNVDHKPSNTKVDK<br>RVESKYGPPCPSCPAPEFLGGPSVFLFPPKPKDTLMISRTPEVT<br>CVVVDVSQEDPEVQFNWYVDGVEVHNAKTKPREEQFNSTYRVVS<br>VLTVLHQDWLNGKEYKCKVSNKGLPSSIEKTISKAKGQPREPQV<br>YTLPPSQEEMTKNQVSLTCLVKGFYPSDIAVEWESNGQPENNYK<br>TTPPVLDSDGSFFLYSRLTVDKSRWQEGNVFSCSVMHEALHNHY<br>TQKSLSLSLG |
| 206 | DNA Heavy Chain | CAGGTGCAGCTGGTGCAGTCTGGGGCTGAGGTGAAGAAGCCTGG<br>GTCCTCGGTGAAGGTCTCCTGCAAGGCTTCTGGAGGCACCTTCA<br>GCGCTTATGCGATCAGCTGGGTGCGACAGGCCCCTGGACAAGGG<br>CTTGAGTGGATGGGAGGGATCATCCCTATCTTTGGTACAGCAAA<br>CTACGCACAGAAGTTCCAGGGCAGAGTCACGATTACCGCGGACG<br>AATCCACGAGCACAGCCTACATGGAGCTGAGCAGCCTGAGATCT<br>GAGGACACGGCGGTGTACTACTGCGCCAGATCTTACTACTCCAG<br>CCGATGGCACTACTACTACTACATGGACGTGTGGGGCAAGGGTA<br>CAACTGTCACCGTCTCCTCAGCTTCCACCAAGGGCCCCTCCGTG<br>TTCCCTCTGGCCCCTTGCTCCCGGTCCACCTCCGAGTCTACCGC<br>CGCTCTGGGCTGCCTCGTGAAGGACTACTTCCCCGAGCCCGTGA<br>CCGTGTCCTGGAACTCTGGCGCCCTGACCTCCGGCGTGCACACC<br>TTCCCTGCCGTGCTGCAGTCCTCCGGCCTGTACTCCCTGTCCAG<br>CGTCGTGACCGTGCCCTCCTCCAGCCTGGGCACCAAGACCTACA<br>CCTGTAACGTGGACCACAAGCCCTCCAACACCAAAGTGGACAAG<br>CGGGTGGAATCTAAGTACGGCCCTCCCTGCCCTTCCTGCCCTGC<br>CCCTGAGTTCCTGGGCGGACCTTCCGTGTTCCTGTTCCCTCCAA |

TABLE 12-continued

SEQUENCE LISTING

| SEQ ID NO | Description | Sequence |
|---|---|---|
| | | AGCCCAAGGACACCCTGATGATCTCCCGGACCCCTGAAGTGACC<br>TGCGTGGTGGTGGACGTGTCCCAGGAAGATCCCGAAGTCCAGTT<br>CAATTGGTACGTGGACGGCGTGGAAGTGCACAACGCCAAGACCA<br>AGCCCAGAGAGGAACAGTTCAACTCCACCTACCGGGTGGTGTCC<br>GTGCTGACCGTGCTGCACCAGGACTGGCTGAACGGCAAAGAGTA<br>CAAGTGCAAAGTGTCCAACAAGGGCCTGCCCTCCAGCATCGAAA<br>AGACCATCTCCAAGGCCAAGGGCCAGCCCCGCGAGCCCCAAGTG<br>TACACCCTGCCTCCCAGCCAGGAAGAGATGACCAAGAATCAAGT<br>GTCCCTGACTTGTCTGGTCAAGGGCTTCTACCCCTCCGATATCG<br>CCGTGGAGTGGGAGTCCAACGGCCAGCCCGAGAACAACTACAAG<br>ACCACCCCTCCCGTGCTGGACTCCGACGGCTCCTTCTTCCTGTA<br>CTCTCGGCTGACCGTGGACAAGTCCCGGTGGCAGGAAGGCAACG<br>TCTTCTCCTGCTCCGTGATGCACGAGGCCCTGCACAACCACTAC<br>ACCCAGAAGTCCCTGTCCCTGTCTCTGGGC |

SRF411-A

| 207 | HCDR1 (IMGT) | GGTFESYT |
| 208 | HCDR2 (IMGT) | IAPIFGTA |
| 209 | HCDR3 (IMGT) | ARSYYSSRWHYYYYMDV |
| 210 | HCDR1 (NT) | GTFESYTIS |
| 211 | HCDR2 (NT) | GIAPIFGTAHYAQKFQG |
| 212 | HCDR3 (NT) | ARSYYSSRWHYYYYMDV |
| 213 | VH | QVQLVQSGAEVKKPGSSVKVSCKASGGTFESYTISWVRQAPGQG<br>LEWMGGIAPIFGTAHYAQKFQGRVTITADESTSTAYMELSSLRS<br>EDTAVYYCARSYYSSRWHYYYYMDVWGKGTTVTVSS |
| 214 | DNA VH | CAGGTGCAGCTGGTGCAGTCTGGGGCTGAGGTGAAGAAGCCTGG<br>GTCCTCGGTGAAGGTCTCCTGCAAGGCTTCTGGAGGCACCTTCG<br>AGAGCTATACGATCAGCTGGGTGCGACAGGCCCCTGGACAAGGG<br>CTTGAGTGGATGGGAGGGATCGCGCCTATCTTTGGTACAGCACA<br>TTACGCACAGAAGTTCCAGGGCAGAGTCACGATTACCGCGGACG<br>AATCCACGAGCACAGCCTACATGGAGCTGAGCAGCCTGAGATCT<br>GAGGACACGGCGGTGTACTACTGCGCCAGATCTTACTACTCCAG<br>CCGATGGCACTACTACTACTACATGGACGTGTGGGGCAAGGGTA<br>CAACTGTCACCGTCTCCTCA |
| 215 | LCDR1 (IMGT) | QGISSW |
| 216 | LCDR2 (IMGT) | AAS |
| 217 | LCDR3 (IMGT) | QQADDLPLT |
| 218 | LCDR1 (NT) | RASQGISSWLA |
| 219 | LCDR2 (NT) | AASNLQS |
| 220 | LCDR3 (NT) | QQADDLPLT |
| 221 | VL | DIQMTQSPSSVSASVGDRVTITCRASQGISSWLAWYQQKPGKAP<br>KLLIYAASNLQSGVPSRFSGSGSGTDFTLTISSLQPEDFATYYC<br>QQADDLPLTFGGGTKVEIK |
| 222 | DNA VL | GACATCCAGATGACCCAGTCTCCATCTTCCGTGTCTGCATCTGT<br>AGGAGACAGAGTCACCATCACTTGTCGGGCGAGTCAGGGTATTA<br>GCAGCTGGTTAGCCTGGTATCAGCAGAAACCAGGGAAAGCCCCT<br>AAGCTCCTGATCTATGCTGCATCCAATTTGCAAAGTGGGGTCCC<br>ATCAAGGTTCAGCGGCAGTGGATCTGGGACAGATTTCACTCTCA<br>CCATCAGCAGCCTGCAGCCTGAAGATTTTGCAACTTACTATTGT<br>CAGCAGGCAGACGACCTCCCTCTCACTTTTGGCGGAGGGACCAA<br>GGTTGAGATCAAA |
| 223 | Heavy Chain | QVQLVQSGAEVKKPGSSVKVSCKASGGTFESYTISWVRQAPGQG<br>LEWMGGIAPIFGTAHYAQKFQGRVTITADESTSTAYMELSSLRS<br>EDTAVYYCARSYYSSRWHYYYYMDVWGKGTTVTVSSASTKGPSV<br>FPLAPSSKSTSGGTAALGCLVKDYFPEPVTVSWNSGALTSGVHT<br>FPAVLQSSGLYSLSSVVTVPSSSLGTQTYICNVNHKPSNTKVDK<br>KVEPKSCDKTHTCPPCPAPELLGGPSVFLFPPKPKDTLMISRTP<br>EVTCVVVDVSHEDPEVKFNWYVDGVEVHNAKTKPREEQYNSTYR<br>VVSVLTVLHQDWLNGKEYKCKVSNKALPAPIEKTISKAKGQPRE<br>PQVYTLPPSRDELTKNQVSLTCLVKGFYPSDIAVEWESNGQPEN<br>NYKTTPPVLDSDGSFFLYSKLTVDKSRWQQGNVFSCSVMHEALH<br>NHYTQKSLSLSPGK |
| 224 | DNA Heavy Chain | CAGGTGCAGCTGGTGCAGTCTGGGGCTGAGGTGAAGAAGCCTGG<br>GTCCTCGGTGAAGGTCTCCTGCAAGGCTTCTGGAGGCACCTTCG<br>AGAGCTATACGATCAGCTGGGTGCGACAGGCCCCTGGACAAGGG<br>CTTGAGTGGATGGGAGGGATCGCGCCTATCTTTGGTACAGCACA<br>TTACGCACAGAAGTTCCAGGGCAGAGTCACGATTACCGCGGACG<br>AATCCACGAGCACAGCCTACATGGAGCTGAGCAGCCTGAGATCT |

TABLE 12-continued

SEQUENCE LISTING

| SEQ ID NO | Description | Sequence |
|---|---|---|
| | | GAGGACACGGCGGTGTACTACTGCGCCAGATCTTACTACTCCAG
CCGATGGCACTACTACTACTACATGGACGTGTGGGGCAAGGGTA
CAACTGTCACCGTCTCCTCAGCGAGCACCAAAGGCCCGAGCGTG
TTTCCGCTGGCGCCGAGCAGAAAGCACCAGCGGCGGCACCGC
GGCGCTGGGCTGCCTGGTGAAAGATTATTTTCCGGAACCGGTGA
CCGTGAGCTGGAACAGCGGCGCGCTGACCAGCGGCGTGCATACC
TTTCCGGCGGTGCTGCAGAGCAGCGGCCTGTATAGCCTGAGCAG
CGTGGTGACCGTGCCGAGCAGCAGCCTGGGCACCCAGACCTATA
TTTGCAACGTGAACCATAAACCGAGCAACACCAAAGTGGATAAA
AAAGTGGAACCGAAAAGCTGCGATAAAACCCATACCTGCCCGCC
GTGCCCGGCGCCGAACTGCTGGGCGGCCCGAGCGTGTTTCTGT
TTCCGCCGAAACCGAAAGATACCCTGATGATTAGCCGCACCCCG
GAAGTGACCTGCGTGGTGGTGGATGTGAGCCATGAAGATCCGGA
AGTGAAATTTAACTGGTATGTGGATGGCGTGGAAGTGCATAACG
CGAAAACCAAACCGCGCGAAGAACAGTATAACAGCACCTATCGC
GTGGTGAGCGTGCTGACCGTGCTGCATCAGGATTGGCTGAACGG
CAAAGAATATAAATGCAAAGTGAGCAACAAAGCGCTGCCGGCGC
CGATTGAAAAAACCATTAGCAAAGCGAAAGGCCAGCCGCGCGAA
CCGCAGGTGTATACCCTGCCGCCGAGCCGCGATGAACTGACCAA
AAACCAGGTGAGCCTGACCTGCCTGGTGAAAGGCTTTTATCCGA
GCGATATTGCGGTGGAATGGGAAAGCAACGGCCAGCCGGAAAAC
AACTATAAAACCACCCCGCCGGTGCTGGATAGCGATGGCAGCTT
TTTTCTGTATAGCAAACTGACCGTGGATAAAAGCCGCTGGCAGC
AGGGCAACGTGTTTAGCTGCAGCGTGATGCATGAAGCGCTGCAT
AACCATTATACCCAGAAAAGCCTGAGCCTGAGCCCGGGCAAA |
| 225 | Light Chain | DIQMTQSPSSVSASVGDRVTITCRASQGISSWLAWYQQKPGKAP
KLLIYAASNLQSGVPSRFSGSGSGTDFTLTISSLQPEDFATYYC
QQADDLPLTFGGGTKVEIKRTVAAPSVFIFPPSDEQLKSGTASV
VCLLNNFYPREAKVQWKVDNALQSGNSQESVTEQDSKDSTYSLS
STLTLSKADYEKHKVYACEVTHQGLSSPVTKSFNRGEC |
| 226 | DNA Light Chain | GACATCCAGATGACCCAGTCTCCATCTTCCGTGTCTGCATCTGT
AGGAGACAGAGTCACCATCACTTGTCGGGCGAGTCAGGGTATTA
GCAGCTGGTTAGCCTGGTATCAGCAGAAACCAGGGAAAGCCCCT
AAGCTCCTGATCTATGCTGCATCCAATTTGCAAAGTGGGGTCCC
ATCAAGGTTCAGCGGCAGTGGATCTGGGACAGATTTCACTCTCA
CCATCAGCAGCCTGCAGCCTGAAGATTTTGCAACTTACTATTGT
CAGCAGGCAGACGACCTCCCTCTCACTTTTGGCGGAGGGACCAA
GGTTGAGATCAAACGTACGGTGGCCGCTCCCTCCGTGTTCATCT
TCCCACCCTCCGACGAGCAGCTGAAGTCCGGCACCGCCTCCGTC
GTGTGCCTGCTGAACAACTTCTACCCTCGCGAGGCCAAAGTGCA
GTGGAAAGTGGACAACGCCCTGCAGTCCGGCAACTCCCAGGAAT
CCGTCACCGAGCAGGACTCCAAGGACAGCACCTACTCCCTGTCC
TCCACCCTGACCCTGTCCAAGGCCGACTACGAGAAGCACAAAGT
GTACGCCTGCGAAGTGACCCACCAGGGCCTGTCCAGCCCCGTGA
CCAAGTCCTTCAACCGGGGCGAGTGC |

SRF411-B

| 227 | Heavy Chain | QVQLVQSGAEVKKPGSSVKVSCKASGGTFESYTISWVRQAPGQG
LEWMGGIAPIFGTAHYAQKFQGRVTITADESTSTAYMELSSLRS
EDTAVYYCARSYYSSRWHYYYYMDVWGKGTTVTVSSASTKGPSV
FPLAPCSRSTSESTAALGCLVKDYFPEPVTVSWNSGALTSGVHT
FPAVLQSSGLYSLSSVVTVPSSSLGTKTYTCNVDHKPSNTKVDK
RVESKYGPPCPSCPAPEFLGGPSVFLFPPKPKDTLMISRTPEVT
CVVVDVSQEDPEVQFNWYVDGVEVHNAKTKPREEQFNSTYRVVS
VLTVLHQDWLNGKEYKCKVSNKGLPSSIEKTISKAKGQPREPQV
YTLPPSQEEMTKNQVSLTCLVKGFYPSDIAVEWESNGQPENNYK
TTPPVLDSDGSFFLYSRLTVDKSRWQEGNVFSCSVMHEALHNHY
TQKSLSLSLG |
| 228 | DNA Heavy Chain | CAGGTGCAGCTGGTGCAGTCTGGGGCTGAGGTGAAGAAGCCTGG
GTCCTCGGTGAAGGTCTCCTGCAAGGCTTCTGGAGGCACCTTCG
AGAGCTATACGATCAGCTGGGTGCGACAGGCCCCTGGACAAGGG
CTTGAGTGGATGGGAGGGATCGCGCCTATCTTTGGTACAGCACA
TTACGCACAGAAGTTCCAGGGCAGAGTCACGATTACCGCGGACG
AATCCACGAGCACAGCCTACATGGAGCTGAGCAGCCTGAGATCT
GAGGACACGGCGGTGTACTACTGCGCCAGATCTTACTACTCCAG
CCGATGGCACTACTACTACTACATGGACGTGTGGGGCAAGGGTA
CAACTGTCACCGTCTCCTCAGCTTCCACCAAGGGCCCCTCCGTG
TTCCCTCTGGCCCCTTGCTCCCGGTCCACCTCCGAGTCTACCGC
CGCTCTGGGCTGCCTCGTGAAGGACTACTTCCCCGAGCCCGTGA
CCGTGTCCTGGAACTCTGGCGCCCTGACCTCCGGCGTGCACACC
TTCCCTGCCGTGCTGCAGTCCTCCGGCCTGTACTCCCTGTCCAG
CGTCGTGACCGTGCCCTCCTCCAGCCTGGGCACCAAGACCTACA
CCTGTAACGTGGACCACAAGCCTCCAACACCAAAGTGGACAAG
CGGGTGGAATCTAAGTACGGCCCTCCCTGCCCTTCCTGCCCTGC |

TABLE 12-continued

SEQUENCE LISTING

| SEQ ID NO | Description | Sequence |
|---|---|---|
| | | CCCTGAGTTCCTGGGCGGACCTTCCGTGTTCCTGTTCCCTCCAA AGCCCAAGGACACCCTGATGATCTCCCGGACCCCTGAAGTGACC TGCCGTGGTGGTGGACGTGTCCCAGGAAGATCCCGAAGTCCAGTT CAATTGGTACGTGGACGGCGTGGAAGTGCACAACGCCAAGACCA AGCCCAGAGAGGAACAGTTCAACTCCACCTACCGGGTGGTGTCC GTGCTGACCGTGCTGCACCAGGACTGGCTGAACGGCAAAGAGTA CAAGTGCAAAGTGTCCAACAAGGCCTGCCCTCCAGCATCGAAA AGACCATCTCCAAGGCCAAGGGCCAGCCCCGCGAGCCCCAAGTG TACACCCTGCCTCCCAGCCAGGAAGAGATGACCAAGAATCAAGT GTCCCTGACTTGTCTGGTCAAGGGCTTCTACCCCTCCGATATCG CCGTGGAGTGGGAGTCCAACGGCCAGCCCGAGAACAACTACAAG ACCACCCCTCCCGTGCTGGACTCCGACGGCTCCTTCTTCCTGTA CTCTCGGCTGACCGTGGACAAGTCCCGGTGGCAGGAAGGCAACG TCTTCTCCTGCTCCGTGATGCACGAGGCCCTGCACAACCACTAC ACCCAGAAGTCCCTGTCCCTGTCTCTGGGC |

SRF543-A

| SEQ ID NO | Description | Sequence |
|---|---|---|
| 229 | HCDR1 (IMGT) | GGSFSDYE |
| 230 | HCDR2 (IMGT) | IDWSGIT |
| 231 | HCDR3 (IMGT) | ARLPMYYYDSSVSTGSVDV |
| 232 | HCDR1 (NT) | GSFSDYEWS |
| 233 | HCDR2 (NT) | EIDWSGITNYNPSLKS |
| 234 | HCDR3 (NT) | ARLPMYYYDSSVSTGSVDV |
| 235 | VH | QVQLQQWGAGLLKPSETLSLTCAVYGGSFSDYEWSWIRQPPGKG LEWIGEIDWSGITNYNPSLKSRVTISVDTSKNQFSLKLSSVTAA DTAVYYCARLPMYYYDSSVSTGSVDVWGQGTMVTVSS |
| 236 | DNA VH | CAAGTACAATTACAACAGTGGGGAGCTGGTTTATTAAAGCCTTC AGAAACTTTAAGTTTGACCTGTGCTGTTTACGGTGGATCATTTT CTGATTATGAGTGGAGTTGGATTCGTCAACCACCAGGCAAAGGA TTGGAGTGGATCGGTGAGATAGACTGGTCAGGCATTACTAACTA CAATCCAAGTTTAAAATCCAGGGTTACTATCTCCGTAGACACGT CCAAGAACCAGTTCTCCCTGAAGCTGAGTTCTGTGACCGCCGCA GACACGGCGGTGTACTACTGCGCGCAGACTTCCTATGTACTACTA CGACAGCAGCGTCTCAACCGGAAGCGTAGACGTATGGGGTCAGG GTACAATGGTCACCGTCTCCTCA |
| 237 | LCDR1 (IMGT) | QSVSSY |
| 238 | LCDR2 (IMGT) | DSS |
| 239 | LCDR3 (IMGT) | QQDSDHPIT |
| 240 | LCDR1 (NT) | RASQSVSSYLA |
| 241 | LCDR2 (NT) | DSSNRAT |
| 242 | LCDR3 (NT) | QQDSDHPIT |
| 243 | VL | EIVLTQSPATLSLSPGERATLSCRASQSVSSYLAWYQQKPGQAP RLLIYDSSNRATGIPARFSGSGSGTDFTLTISSLEPEDFAVYYC QQDSDHPITFGGGTKVEIK |
| 244 | DNA VL | GAAATTGTGTTGACACAGTCTCCAGCCACCCTGTCTTTGTCTCC AGGGGAAAGAGCCACCCTCTCCTGCAGGGCCAGTCAGAGTGTTA GCAGCTACTTAGCCTGGTACCAACAGAAACCTGGCCAGGCTCCC AGGCTCCTCATCTATGATTCATCCAACAGGGCCACTGGCATCCC AGCCAGGTTCAGTGGCAGTGGGTCTGGGACAGACTTCACTCTCA CCATCAGCAGCCTAGAGCCTGAAGATTTTGCAGTTTATTACTGT CAGCAGGACAGTGACCACCCTATCACTTTTGGCGGAGGGACCAA GGTTGAGATCAAA |
| 245 | Heavy Chain | QVQLQQWGAGLLKPSETLSLTCAVYGGSFSDYEWSWIRQPPGKG LEWIGEIDWSGITNYNPSLKSRVTISVDTSKNQFSLKLSSVTAA DTAVYYCARLPMYYYDSSVSTGSVDVWGQGTMVTVSSASTKGPS VFPLAPSSKSTSGGTAALGCLVKDYFPEPVTVSWNSGALTSGVH TFPAVLQSSGLYSLSSVVTVPSSSLGTQTYICNVNHKPSNTKVD KKVEPKSCDKTHTCPPCPAPELLGGPSVFLFPPKPKDTLMISRT PEVTCVVVDVSHEDPEVKFNWYVDGVEVHNAKTKPREEQYNSTY RVVSVLTVLHQDWLNGKEYKCKVSNKALPAPIEKTISKAKGQPR EPQVYTLPPSRDELTKNQVSLTCLVKGFYPSDIAVEWESNGQPE NNYKTTPPVLDSDGSFFLYSKLTVDKSRWQQGNVFSCSVMHEAL HNHYTQKSLSLSPGK |
| 246 | DNA Heavy Chain | CAAGTACAATTACAACAGTGGGGAGCTGGTTTATTAAAGCCTTC AGAAACTTTAAGTTTGACCTGTGCTGTTTACGGTGGATCATTTT CTGATTATGAGTGGAGTTGGATTCGTCAACCACCAGGCAAAGGA TTGGAGTGGATCGGTGAGATAGACTGGTCAGGCATTACTAACTA CAATCCAAGTTTAAAATCCAGGGTTACTATCTCCGTAGACACGT |

TABLE 12-continued

SEQUENCE LISTING

| SEQ ID NO | Description | Sequence |
|---|---|---|
| | | CCAAGAACCAGTTCTCCCTGAAGCTGAGTTCTGTGACCGCCGCA GACACGGCGGTGTACTACTGCGCCAGACTTCCTATGTACTACTA CGACAGCAGCGTCTCAACCGGAAGCGTAGACGTATGGGGTCAGG GTACAATGGTCACCGTCTCCTCAGCGAGCACCAAAGGCCCGAGC GTGTTTCCGCTGGCGCCGAGCAGCAAAAGCACCAGCGGCGGCAC CGCGGCGCTGGGCTGCCTGGTGAAAGATTATTTTCCGGAACCGG TGACCGTGAGCTGGAACAGCGGCGCGCTGACCAGCGGCGTGCAT ACCTTTCCGGCGGTGCTGCAGAGCAGCGGCCTGTATAGCCTGAG CAGCGTGGTGACCGTGCCGAGCAGCAGCCTGGGCACCCAGACCT ATATTTGCAACGTGAACCATAAACCGAGCAACACCAAAGTGGAT AAAAAAGTGGAACCGAAAAGCTGCGATAAAACCCATACCTGCCC GCCGTGCCCGGCGCCGGAACTGCTGGGCGGCCCGAGCGTGTTTC TGTTTCCGCCGAAACCGAAAGATACCCTGATGATTAGCCGCACC CCGGAAGTGACCTGCGTGGTGGTGGATGTGAGCCATGAAGATCC GGAAGTGAAATTTAACTGGTATGTGGATGGCGTGGAAGTGCATA ACGCGAAAACCAAACCGCGCGAAGAACAGTATAACAGCACCTAT CGCGTGGTGAGCGTGCTGACCGTGCTGCATCAGGATTGGCTGAA CGGCAAAGAATATAAATGCAAAGTGAGCAACAAAGCGCTGCCGG CGCCGATTGAAAAAACCATTAGCAAAGCGAAAGGCCAGCCGCGC GAACCGCAGGTGTATACCCTGCCGCCGAGCCGCGATGAACTGAC CAAAAACCAGGTGAGCCTGACCTGCCTGGTGAAAGGCTTTTATC CGAGCGATATTGCGGTGGAATGGGAAAGCAACGGCCAGCCGGAA AACAACTATAAAACCACCCCGCCGGTGCTGGATAGCGATGGCAG CTTTTTTCTGTATAGCAAACTGACCGTGGATAAAAGCCGCTGGC AGCAGGGCAACGTGTTTAGCTGCAGCGTGATGCATGAAGCGCTG CATAACCATTATACCCAGAAAAGCCTGAGCCTGAGCCCGGGCAA A |
| 247 | Light Chain | EIVLTQSPATLSLSPGERATLSCRASQSVSSYLAWYQQKPGQAP RLLIYDSSNRATGIPARFSGSGSGTDFTLTISSLEPEDFAVYYC QQDSDHPITFGGGTKVEIKRTVAAPSVFIFPPSDEQLKSGTASV VCLLNNFYPREAKVQWKVDNALQSGNSQESVTEQDSKDSTYSLS STLTLSKADYEKHKVYACEVTHQGLSSPVTKSFNRGEC |
| 248 | DNA Light Chain | GAAATTGTGTTGACACAGTCTCCAGCCACCCTGTCTTTGTCTCC AGGGGAAAGAGCCACCCTCTCCTGCAGGGCCAGTCAGAGTGTTA GCAGCTACTTAGCCTGGTACCAACAGAAACCTGGCCAGGCTCCC AGGCTCCTCATCTATGATTCATCCAACAGGGCCACTGGCATCCC AGCCAGGTTCAGTGGCAGTGGGTCTGGGACAGACTTCACTCTCA CCATCAGCAGCCTAGAGCCTGAAGATTTTGCAGTTTATTACTGT CAGCAGGACAGTGACCACCCTATCACTTTTGGCGGAGGGACCAA GGTTGAGATCAAACGTACGGTGGCCGCTCCCTCCGTGTTCATCT TCCCACCCTCCGACGAGCAGCTGAAGTCCGGCACCGCCTCCGTC GTGTGCCTGCTGAACAACTTCTACCCTCGCGAGGCCAAAGTGCA GTGGAAAGTGGACAACGCCCTGCAGTCCGGCAACTCCCAGGAAT CCGTCACCGAGCAGGACTCCAAGGACAGCACCTACTCCCTGTCC TCCACCCTGACCCTGTCCAAGGCCGACTACGAGAAGCACAAAGT GTACGCCTGCGAAGTGACCCACCAGGGCCTGTCCAGCCCCGTGA CCAAGTCCTTCAACCGGGGCGAGTGC |

SRF543-B

| 249 | Heavy Chain | QVQLQQWGAGLLKPSETLSLTCAVYGGSFSDYEWSWIRQPPGKG LEWIGEIDWSGITNYNPSLKSRVTISVDTSKNQFSLKLSSVTAA DTAVYYCARLPMYYYDSSVSTGSVDVWGQGTMVTVSSASTKGPS VFPLAPCSRSTSESTAALGCLVKDYFPEPVTVSWNSGALTSGVH TFPAVLQSSGLYSLSSVVTVPSSSLGTKTYTCNVDHKPSNTKVD KRVESKYGPPCPSCPAPEFLGGPSVFLFPPKPKDTLMISRTPEV TCVVVDVSQEDPEVQFNWYVDGVEVHNAKTKPREEQFNSTYRVV SVLTVLHQDWLNGKEYKCKVSNKGLPSSIEKTISKAKGQPREPQ VYTLPPSQEEMTKNQVSLTCLVKGFYPSDIAVEWESNGQPENNY KTTPPVLDSDGSFFLYSRLTVDKSRWQEGNVFSCSVMHEALHNH YTQKSLSLSLG |
| 250 | DNA Heavy Chain | CAAGTACAATTACAACAGTGGGGAGCTGGTTTATTAAAGCCTTC AGAAACTTTAAGTTTGACCTGTGCTGTTTACGGTGGATCATTTT CTGATTATGAGTGGAGTTGGATTCGTCAACCACCAGGCAAAGGA TTGGAGTGGATCGGTGAGATAGACTGGTCAGGCATTACTAACTA CAATCCAAGTTTAAAATCCAGGGTTACTATCTCCGTAGACACGT CCAAGAACCAGTTCTCCCTGAAGCTGAGTTCTGTGACCGCCGCA GACACGGCGGTGTACTACTGCGCCAGACTTCCTATGTACTACTA CGACAGCAGCGTCTCAACCGGAAGCGTAGACGTATGGGGTCAGG GTACAATGGTCACCGTCTCCTCAGCTTCCACCAAGGGCCCATCC GTGTTCCCTCTGGCCCCTTGCTCCCGGTCCACCTCCGAGTCTAC CGCCGCTCTGGGCTGCCTCGTGAAGGACTACTTCCCCGAGCCCG TGACCGTGTCCTGGAACTCTGGCGCCCTGACCTCCGGCGTGCAC ACCTTCCCTGCCGTGCTGCAGTCCTCCGGCCTGTACTCCCTGTC CAGCGTCGTGACCGTGCCCTCCTCCAGCCTGGGCACCAAGACCT |

TABLE 12-continued

SEQUENCE LISTING

| SEQ ID NO | Description | Sequence |
|---|---|---|
| | | ACACCTGTAACGTGGACCACAAGCCCTCCAACACCAAAGTGGAC<br>AAGCGGGTGGAATCTAAGTACGGCCCTCCCTGCCCTTCCTGCCC<br>TGCCCCTGAGTTCCTGGGCGGACCTTCCGTGTTCCTGTTCCCTC<br>CAAAGCCCAAGGACACCCTGATGATCTCCCGGACCCCTGAAGTG<br>ACCTGCGTGGTGGTGGACGTGTCCCAGGAAGATCCCGAAGTCCA<br>GTTCAATTGGTACGTGGACGGCGTGGAAGTGCACAACGCCAAGA<br>CCAAGCCCAGAGAGGAACAGTTCAACTCCACCTACCGGGTGGTG<br>TCCGTGCTGACCGTGCTGCACCAGGACTGGCTGAACGGCAAGA<br>GTACAAGTGCAAAGTGTCCAACAAGGGCCTGCCCTCCAGCATCG<br>AAAAGACCATCTCCAAGGCCAAGGGCCAGCCCCGCGAGCCCCAA<br>GTGTACACCCTGCCTCCCAGCCAGGAAGAGATGACCAAGAATCA<br>AGTGTCCCTGACTTGTCTGGTCAAGGGCTTCTACCCCTCCGATA<br>TCGCCGTGGAGTGGGAGTCCAACGGCCAGCCCGAGAACAACTAC<br>AAGACCACCCCTCCCGTGCTGGACTCCGACGGCTCCTTCTTCCT<br>GTACTCTCGGCTGACCGTGGACAAGTCCCGGTGGCAGGAAGGCA<br>ACGTCTTCTCCTGCTCCGTGATGCACGAGGCCCTGCACAACCAC<br>TACACCCAGAAGTCCCTGTCCCTGTCTCTGGGC |

SRF414-A

| SEQ ID NO | Description | Sequence |
|---|---|---|
| 251 | HCDR1 (IMGT) | GGSFSRYY |
| 252 | HCDR2 (IMGT) | IDYSGST |
| 253 | HCDR3 (IMGT) | ARDGVYYDSSDLGFDI |
| 254 | HCDR1 (NT) | GSFSRYYWS |
| 255 | HCDR2 (NT) | SIDYSGSTEYNPSLKS |
| 256 | HCDR3 (NT) | ARDGVYYDSSDLGFDI |
| 257 | VH | QVQLQQWGAGLLKPSETLSLTCAVYGGSFSRYYWSWIRQPPGKG<br>LEWIGSIDYSGSTEYNPSLKSRVTISVDTSKNQFSLKLSSVTAA<br>DTAVYYCARDGVYYDSSDLGFDIWGQGTMVTVSS |
| 258 | DNA VH | CAAGTACAATTACAACAGTGGGGAGCTGGTTTATTAAAGCCTTC<br>AGAAACTTTAAGTTTGACCTGTGCTGTTTACGGTGGATCATTTT<br>CTCGTTATTACTGGAGTTGGATTCGTCAACCACCAGGCAAAGGA<br>TTGGAGTGGATCGGTAGTATAGACTATTCAGGCTCCACTGAGTA<br>CAATCCAAGTTTAAAATCCAGGGTTACTATCTCCGTAGACACGT<br>CCAAGAACCAGTTCTCCCTGAAGCTGAGTTCTGTGACCGCCGCA<br>GACACGGCGGTGTACTACTGCGCCAGAGATGGTGTGTACTACGA<br>CAGCAGCGACTTGGGATTCGACATATGGGGTCAGGGTACAATGG<br>TCACCGTCTCCTCA |
| 259 | LCDR1 (IMGT) | QDISNY |
| 260 | LCDR2 (IMGT) | DAS |
| 261 | LCDR3 (IMGT) | QQYDDLPIT |
| 262 | LCDR1 (NT) | QASQDISNYLN |
| 263 | LCDR2 (NT) | DASNLET |
| 264 | LCDR3 (NT) | QQYDDLPIT |
| 265 | VL | DIQMTQSPSSLSASVGDRVTITCQASQDISNYLNWYQQKPGKAP<br>KLLIYDASNLETGVPSRFSGSGSGTDFTFTISSLQPEDIATYYC<br>QQYDDLPITFGGGTKVEIK |
| 266 | DNA VL | GACATCCAGATGACCCAGTCTCCATCCTCCCTGTCTGCATCTGT<br>AGGAGACAGAGTCACCATCACTTGCCAGGCGAGTCAGGACATTA<br>GCAACTATTTAAATTGGTATCAGCAGAAACCAGGGAAAGCCCT<br>AAGCTCCTGATCTACGATGCATCCAATTTGGAAACAGGGGTCCC<br>ATCAAGGTTCAGTGGAAGTGGATCTGGGACAGATTTTACTTTCA<br>CCATCAGCAGCCTGCAGCCTGAAGATATTGCAACATATTACTGT<br>CAGCAGTACGACGACCTCCCTATCACTTTTGGCGGAGGGACCAA<br>GGTTGAGATCAAA |
| 267 | Heavy Chain | QVQLQQWGAGLLKPSETLSLTCAVYGGSFSRYYWSWIRQPPGKG<br>LEWIGSIDYSGSTEYNPSLKSRVTISVDTSKNQFSLKLSSVTAA<br>DTAVYYCARDGVYYDSSDLGFDIWGQGTMVTVSSASTKGPSVFP<br>LAPSSKSTSGGTAALGCLVKDYFPEPVTVSWNSGALTSGVHTFP<br>AVLQSSGLYSLSSVVTVPSSSLGTQTYICNVNHKPSNTKVDKKV<br>EPKSCDKTHTCPPCPAPELLGGPSVFLFPPKPKDTLMISRTPEV<br>TCVVVDVSHEDPEVKFNWYVDGVEVHNAKTKPREEQYNSTYRVV<br>SVLTVLHQDWLNGKEYKCKVSNKALPAPIEKTISKAKGQPREPQ<br>VYTLPPSRDELTKNQVSLTCLVKGFYPSDIAVEWESNGQPENNY<br>KTTPPVLDSDGSFFLYSKLTVDKSRWQQGNVFSCSVMHEALHNH<br>YTQKSLSLSPGK |

TABLE 12-continued

SEQUENCE LISTING

| SEQ ID NO | Description | Sequence |
|---|---|---|
| 268 | DNA Heavy Chain | CAAGTACAATTACAACAGTGGGGAGCTGGTTTATTAAAGCCTTC
AGAAACTTTAAGTTTGACCTGTGCTGTTTACGGTGGATCATTTT
CTCGTTATTACTGGAGTTGGATTCGTCAACCACCAGGCAAAGGA
TTGGAGTGGATCGGTAGTATAGACTATTCAGGCTCCACTGAGTA
CAATCCAAGTTTAAAATCCAGGGTTACTATCTCCGTAGACACGT
CCAAGAACCAGTTCTCCCTGAAGCTGAGTTCTGTGACCGCCGCA
GACACGGCGGTGTACTACTGCGCCAGAGATGGTGTGTACTACGA
CAGCAGCGACTTGGGATTCGACATATGGGGTCAGGGTACAATGG
TCACCGTCTCCTCAGCGAGCACCAAAGGCCCGAGCGTGTTTCCG
CTGGCGCCGAGCAGCAAAAGCACCAGCGGCGGCACCGCGGCGCT
GGGCTGCCTGGTGAAAGATTATTTTCCGGAACCGGTGACCGTGA
GCTGGAACAGCGGCGCGCTGACCAGCGGCGTGCATACCTTTCCG
GCGGTGCTGCAGAGCAGCGGCCTGTATAGCCTGAGCAGCGTGGT
GACCGTGCCGAGCAGCAGCCTGGGCACCCAGACCTATATTTGCA
ACGTGAACCATAAACCGAGCAACACCAAAGTGGATAAAAAAGTG
GAACCGAAAAGCTGCGATAAAACCCATACCTGCCCGCCGTGCCC
GGCGCCGGAACTGCTGGGCGGCCCGAGCGTGTTTCTGTTTCCGC
CGAAACCGAAAGATACCCTGATGATTAGCCGCACCCCGGAAGTG
ACCTGCGTGGTGGTGGATGTGAGCCATGAAGATCCGGAAGTGAA
ATTTAACTGGTATGTGGATGGCGTGGAAGTGCATAACGCGAAAA
CCAAACCGCGCGAAGAACAGTATAACAGCACCTATCGCGTGGTG
AGCGTGCTGACCGTGCTGCATCAGGATTGGCTGAACGGCAAAGA
ATATAAATGCAAAGTGAGCAACAAAGCGCTGCCGGCGCCGATTG
AAAAAACCATTAGCAAAGCGAAAGGCCAGCCGCGCGAACCGCAG
GTGTATACCCTGCCGCCGAGCCGCGATGAACTGACCAAAAACCA
GGTGAGCCTGACCTGCCTGGTGAAAGGCTTTTATCCGAGCGATA
TTGCGGTGGAATGGGAAAGCAACGGCCAGCCGGAAAACAACTAT
AAAACCACCCCGCCGGTGCTGGATAGCGATGGCAGCTTTTTTCT
GTATAGCAAACTGACCGTGGATAAAAGCCGCTGGCAGCAGGGCA
ACGTGTTTAGCTGCAGCGTGATGCATGAAGCGCTGCATAACCAT
TATACCCAGAAAAGCCTGAGCCTGAGCCCGGGCAAA |
| 269 | Light Chain | DIQMTQSPSSLSASVGDRVTITCQASQDISNYLNWYQQKPGKAP
KLLIYDASNLETGVPSRFSGSGSGTDFTFTISSLQPEDIATYYC
QQYDDLPITFGGGTKVEIKRTVAAPSVFIFPPSDEQLKSGTASV
VCLLNNFYPREAKVQWKVDNALQSGNSQESVTEQDSKDSTYSLS
STLTLSKADYEKHKVYACEVTHQGLSSPVTKSFNRGEC |
| 270 | DNA Light Chain | GACATCCAGATGACCCAGTCTCCATCCTCCCTGTCTGCATCTGT
AGGAGACAGAGTCACCATCACTTGCCAGGCGAGTCAGGACATTA
GCAACTATTTAAATTGGTATCAGCAGAAACCAGGGAAAGCCCCT
AAGCTCCTGATCTACGATGCATCCAATTTGGAAACAGGGGTCCC
ATCAAGGTTCAGTGGAAGTGGATCTGGGACAGATTTTACTTTCA
CCATCAGCAGCCTGCAGCCTGAAGATATTGCAACATATTACTGT
CAGCAGTACGACGACCTCCCTATCACTTTTGGCGGAGGGACCAA
GGTTGAGATCAAACGTACGGTGGCCGCTCCCTCCGTGTTCATCT
TCCCACCCTCCGACGAGCAGCTGAAGTCCGGCACCGCCTCCGTC
GTGTGCCTGCTGAACAACTTCTACCCTCGCGAGGCCAAAGTGCA
GTGGAAAGTGGACAACGCCCTGCAGTCCGGCAACTCCCAGGAAT
CCGTCACCGAGCAGGACTCCAAGGACAGCACCTACTCCCTGTCC
TCCACCCTGACCCTGTCCAAGGCCGACTACGAGAAGCACAAAGT
GTACGCCTGCGAAGTGACCCACCAGGGCCTGTCCAGCCCCGTGA
CCAAGTCCTTCAACCGGGGCGAGTGC |

SRF414-B

| 271 | Heavy Chain | QVQLQQWGAGLLKPSETLSLTCAVYGGSFSRYYWSWIRQPPGKG
LEWIGSIDYSGSTEYNPSLKSRVTISVDTSKNQFSLKLSSVTAA
DTAVYYCARDGVYYDSSDLGFDIWGQGTMVTVSSASTKGPSVFP
LAPCSRSTSESTAALGCLVKDYFPEPVTVSWNSGALTSGVHTFP
AVLQSSGLYSLSSVVTVPSSSLGTKTYTCNVDHKPSNTKVDKRV
ESKYGPPCPSCPAPEFLGGPSVFLFPPKPKDTLMISRTPEVTCV
VVDVSQEDPEVQFNWYVDGVEVHNAKTKPREEQFNSTYRVVSVL
TVLHQDWLNGKEYKCKVSNKGLPSSIEKTISKAKGQPREPQVYT
LPPSQEEMTKNQVSLTCLVKGFYPSDIAVEWESNGQPENNYKTT
PPVLDSDGSFFLYSRLTVDKSRWQEGNVFSCSVMHEALHNHYTQ
KSLSLSLG |
| 272 | DNA Heavy Chain | CAAGTACAATTACAACAGTGGGGAGCTGGTTTATTAAAGCCTTC
AGAAACTTTAAGTTTGACCTGTGCTGTTTACGGTGGATCATTTT
CTCGTTATTACTGGAGTTGGATTCGTCAACCACCAGGCAAAGGA
TTGGAGTGGATCGGTAGTATAGACTATTCAGGCTCCACTGAGTA
CAATCCAAGTTTAAAATCCAGGGTTACTATCTCCGTAGACACGT
CCAAGAACCAGTTCTCCCTGAAGCTGAGTTCTGTGACCGCCGCA
GACACGGCGGTGTACTACTGCGCCAGAGATGGTGTGTACTACGA
CAGCAGCGACTTGGGATTCGACATATGGGGTCAGGGTACAATGG
TCACCGTCTCCTCAGCTTCCACCAAGGGCCCCTCCGTGTTCCCT
CTGGCCCCTTGCTCCCGGTCCACCTCCGAGTCTACCGCCGCTCT |

TABLE 12-continued

SEQUENCE LISTING

| SEQ ID NO | Description | Sequence |
|---|---|---|
| | | GGGCTGCCTCGTGAAGGACTACTTCCCCGAGCCCGTGACCGTGT |
| | | CCTGGAACTCTGGCGCCCTGACCTCCGGCGTGCACACCTTCCCT |
| | | GCCGTGCTGCAGTCCTCCGGCCTGTACTCCCTGTCCAGCGTCGT |
| | | GACCGTGCCCTCCTCAGCCTGGGCACCAAGACCTACACCTGTA |
| | | ACGTGGACCACAAGCCCTCCAACACCAAAGTGGACAAGCGGGTG |
| | | GAATCTAAGTACGGCCCTCCCTGCCCTTCCTGCCCTGCCCCTGA |
| | | GTTCCTGGGCGGACCTTCCGTGTTCCTGTTCCCTCCAAAGCCCA |
| | | AGGACACCCTGATGATCTCCCGGACCCCTGAAGTGACCTGCGTG |
| | | GTGGTGGACGTGTCCCAGGAAGATCCCGAAGTCCAGTTCAATTG |
| | | GTACGTGGACGGCGTGGAAGTGCACAACGCCAAGACCAAGCCCA |
| | | GAGAGGAACAGTTCAACTCCACCTACCGGGTGGTGTCCGTGCTG |
| | | ACCGTGCTGCACCAGGACTGGCTGAACGGCAAAGAGTACAAGTG |
| | | CAAAGTGTCCAACAAGGGCCTGCCCTCCAGCATCGAAAAGACCA |
| | | TCTCCAAGGCCAAGGGCCAGCCCCGCGAGCCCCAAGTGTACACC |
| | | CTGCCTCCCAGCCAGGAAGAGATGACCAAGAATCAAGTGTCCCT |
| | | GACTTGTCTGGTCAAGGGCTTCTACCCCTCCGATATCGCCGTGG |
| | | AGTGGGAGTCCAACGGCCAGCCCGAGAACAACTACAAGACCACC |
| | | CCTCCCGTGCTGGACTCCGACGGCTCCTTCTTCCTGTACTCTCG |
| | | GCTGACCGTGGACAAGTCCCGGTGGCAGGAAGGCAACGTCTTCT |
| | | CCTGCTCCGTGATGCACGAGGCCCTGCACAACCACTACACCCAG |
| | | AAGTCCCTGTCCCTGTCTCTGGGC |

SRF557-A

| 273 | HCDR1 (IMGT) | GGTFSSYA |
| 274 | HCDR2 (IMGT) | IIPIFGTA |
| 275 | HCDR3 (IMGT) | ARLGGRGYADEGWYFDL |
| 276 | HCDR1 (NT) | GTFSSYAIS |
| 277 | HCDR2 (NT) | GIIPIFGTANYAQKFQG |
| 278 | HCDR3 (NT) | ARLGGRGYADEGWYFDL |
| 279 | VH | QVQLVQSGAEVKKPGSSVKVSCKASGGTFSSYAISWVRQAPGQG |
| | | LEWMGGIIPIFGTANYAQKFQGRVTITADESTSTAYMELSSLRS |
| | | EDTAVYYCARLGGRGYADEGWYFDLWGRGTLVTVSS |
| 280 | DNA VH | CAGGTGCAGCTGGTGCAGTCTGGGGCTGAGGTGAAGAAGCCTGG |
| | | GTCCTCGGTGAAGGTCTCCTGCAAGGCTTCTGGAGGCACCTTCA |
| | | GCAGCTATGCTATCAGCTGGGTGCGACAGGCCCCTGGACAAGGG |
| | | CTTGAGTGGATGGGAGGGATCATCCCTATCTTTGGTACAGCAAA |
| | | CTACGCACAGAAGTTCCAGGGCAGAGTCACGATTACCGCGGACG |
| | | AATCCACGAGCACAGCCTACATGGAGCTGAGCAGCCTGAGATCT |
| | | GAGGACACGGCGGTGTACTACTGCGCCAGATTGGGCGGACGGGG |
| | | ATACGCCGACGAGGGCTGGTACTTCGACCTATGGGGGAGAGGTA |
| | | CCTTGGTCACCGTCTCCTCA |
| 281 | LCDR1 (IMGT) | QSVSSSY |
| 282 | LCDR2 (IMGT) | GAS |
| 283 | LCDR3 (IMGT) | QQYYGSPIT |
| 284 | LCDR1 (NT) | RASQSVSSSYLA |
| 285 | LCDR2 (NT) | GASSRAT |
| 286 | LCDR3 (NT) | QQYYGSPIT |
| 287 | VL | EIVLTQSPGTLSLSPGERATLSCRASQSVSSSYLAWYQQKPGQA |
| | | PRLLIYGASSRATGIPDRFSGSGSGTDFTLTISRLEPEDFAVYY |
| | | CQQYYGSPITFGGGTKVEIK |
| 288 | DNA VL | GAAATTGTGTTGACGCAGTCTCCAGGCACCCTGTCTTTGTCTCC |
| | | AGGGGAAAGAGCCACCCTCTCCTGCAGGGCCAGTCAGAGTGTTA |
| | | GCAGCAGCTACTTAGCCTGGTACCAGCAGAAACCTGGCCAGGCT |
| | | CCCAGGCTCCTCATCTATGGTGCATCCAGCAGGGCCACTGGCAT |
| | | CCCAGACAGGTTCAGTGGCAGTGGGTCTGGGACAGACTTCACTC |
| | | TCACCATCAGCAGACTGGAGCCTGAAGATTTTGCAGTGTATTAC |
| | | TGTCAGCAGTACTACGGCAGTCCTATCACTTTTGGCGGAGGGAC |
| | | CAAGGTTGAGATCAAA |
| 289 | Heavy Chain | QVQLVQSGAEVKKPGSSVKVSCKASGGTFSSYAISWVRQAPGQG |
| | | LEWMGGIIPIFGTANYAQKFQGRVTITADESTSTAYMELSSLRS |
| | | EDTAVYYCARLGGRGYADEGWYFDLWGRGTLVTVSSASTKGPSV |
| | | FPLAPSSKSTSGGTAALGCLVKDYFPEPVTVSWNSGALTSGVHT |
| | | FPAVLQSSGLYSLSSVVTVPSSSLGTQTYICNVNHKPSNTKVDK |
| | | KVEPKSCDKTHTCPPCPAPELLGGPSVFLFPPKPKDTLMISRTP |
| | | EVTCVVVDVSHEDPEVKFNWYVDGVEVHNAKTKPREEQYNSTYR |
| | | VVSVLTVLHQDWLNGKEYKCKVSNKALPAPIEKTISKAKGQPRE |

TABLE 12-continued

SEQUENCE LISTING

| SEQ ID NO | Description | Sequence |
|---|---|---|
| | | PQVYTLPPSRDELTKNQVSLTCLVKGFYPSDIAVEWESNGQPEN NYKTTPPVLDSDGSFFLYSKLTVDKSRWQQGNVFSCSVMHEALH NHYTQKSLSLSPGK |
| 290 | DNA Heavy Chain | CAGGTGCAGCTGGTGCAGTCTGGGGCTGAGGTGAAGAAGCCTGG GTCCTCGGTGAAGGTCTCCTGCAAGGCTTCTGGAGGCACCTTCA GCAGCTATGCTATCAGCTGGGTGCGACAGGCCCCTGGACAAGGG CTTGAGTGGATGGGAGGGATCATCCCTATCTTTGGTACAGCAAA CTACGCACAGAAGTTCCAGGGCAGAGTCACGATTACCGCGGACG AATCCACGAGCACAGCCTACATGGAGCTGAGCAGCCTGAGATCT GAGGACACGGCGGTGTACTACTGCGCCAGATTGGGCGGACGGGG ATACGCCGACGAGGGCTGGTACTTCGACCTATGGGGAGAGGTA CCTTGGTCACCGTCTCCTCAGCGAGCACCAAAGGCCCGAGCGTG TTTCCGCTGGCGCCGAGCAGCAAAAGCACCAGCGGCGGCACCGC GGCGCTGGGCTGCCTGGTGAAAGATTATTTTCCGGAACCGGTGA CCGTGAGCTGGAACAGCGGCGCGCTGACCAGCGGCGTGCATACC TTTCCGGCGGTGCTGCAGAGCAGCGGCCTGTATAGCCTGAGCAG CGTGGTGACCGTGCCGAGCAGCAGCCTGGGCACCCAGACCTATA TTTGCAACGTGAACCATAAACCGAGCAACACCAAAGTGGATAAA AAAGTGGAACCGAAAAGCTGCGATAAAACCCATACCTGCCCGCC GTGCCCGGCGCCGGAACTGCTGGGCGGCCCGAGCGTGTTTCTGT TTCCGCCGAAACCGAAAGATACCCTGATGATTAGCCGCACCCCG GAAGTGACCTGCGTGGTGGTGGATGTGAGCCATGAAGATCCGGA AGTGAAATTTAACTGGTATGTGGATGGCGTGGAAGTGCATAACG CGAAAACCAAACCGCGCGAAGAACAGTATAACAGCACCTATCGC GTGGTGAGCGTGCTGACCGTGCTGCATCAGGATTGGCTGAACGG CAAAGAATATAAATGCAAAGTGAGCAACAAAGCGCTGCCGGCGC CGATTGAAAAAACCATTAGCAAAGCGAAAGGCCAGCCGCGCGAA CCGCAGGTGTATACCCTGCCGCCGAGCCGCGATGAACTGACCAA AAACCAGGTGAGCCTGACCTGCCTGGTGAAAGGCTTTTATCCGA GCGATATTGCCGTGGAATGGGAAAGCAACGGCCAGCCGGAAAAC AACTATAAAACCACCCCGCCGGTGCTGGATAGCGATGGCAGCTT TTTTCTGTATAGCAAACTGACCGTGGATAAAAGCCGCTGGCAGC AGGGCAACGTGTTTAGCTGCAGCGTGATGCATGAAGCGCTGCAT AACCATTATACCCAGAAAAGCCTGAGCCTGAGCCCGGGCAAA |
| 291 | Light Chain | EIVLTQSPGTLSLSPGERATLSCRASQSVSSSYLAWYQQKPGQA PRLLIYGASSRATGIPDRFSGSGSGTDFTLTISRLEPEDFAVYY CQQYYGSPITFGGGTKVEIKRTVAAPSVFIFPPSDEQLKSGTAS VVCLLNNFYPREAKVQWKVDNALQSGNSQESVTEQDSKDSTYSL SSTLTLSKADYEKHKVYACEVTHQGLSSPVTKSFNRGEC |
| 292 | DNA Light Chain | GAAATTGTGTTGACGCAGTCTCCAGGCACCCTGTCTTTGTCTCC AGGGGAAAGAGCCACCCTCTCCTGCAGGGCCAGTCAGAGTGTTA GCAGCAGCTACTTAGCCTGGTACCAGCAGAAACCTGGCCAGGCT CCCAGGCTCCTCATCTATGGTGCATCCAGCAGGGCCACTGGCAT CCCAGACAGGTTCAGTGGCAGTGGGTCTGGGACAGACTTCACTC TCACCATCAGCAGACTGGAGCCTGAAGATTTTGCAGTGTATTAC TGTCAGCAGTACTACGGCAGTCCTATCACTTTTGGCGGAGGGAC CAAGGTTGAGATCAAACGTACGGTGGCCGCTCCCTCCGTGTTCA TCTTCCCACCCTCCGACGAGCAGCTGAAGTCCGGCACCGCCTCC GTCGTGTGCCTGCTGAACAACTTCTACCCTCGCGAGGCCAAAGT GCAGTGGAAAGTGGACAACGCCCTGCAGTCCGGCAACTCCCAGG AATCCGTCACCGAGCAGGACTCCAAGGACAGCACCTACTCCCTG TCCTCCACCCTGACCCTGTCCAAGGCCGACTACGAGAAGCACAA AGTGTACGCCTGCGAAGTGACCCACCAGGGCCTGTCCAGCCCCG TGACCAAGTCCTTCAACCGGGGCGAGTGC |

SRF557-B

| 293 | Heavy Chain | QVQLVQSGAEVKKPGSSVKVSCKASGGTFSSYAISWVRQAPGQG LEWMGGIIPIFGTANYAQKFQGRVTITADESTSTAYMELSSLRS EDTAVYYCARLGGRGYADEGWYFDLWGRGTLVTVSSASTKGPSV FPLAPCSRSTSESTAALGCLVKDYFPEPVTVSWNSGALTSGVHT FPAVLQSSGLYSLSSVVTVPSSSLGTKTYTCNVDHKPSNTKVDK RVESKYGPPCPSCPAPEFLGGPSVFLFPPKPKDTLMISRTPEVT CVVVDVSQEDPEVQFNWYVDGVEVHNAKTKPREEQFNSTYRVVS VLTVLHQDWLNGKEYKCKVSNKGLPSSIEKTISKAKGQPREPQV YTLPPSQEEMTKNQVSLTCLVKGFYPSDIAVEWESNGQPENNYK TTPPVLDSDGSFFLYSRLTVDKSRWQEGNVFSCSVMHEALHNHY TQKSLSLSLG |
| 294 | DNA Heavy Chain | CAGGTGCAGCTGGTGCAGTCTGGGGCTGAGGTGAAGAAGCCTGG GTCCTCGGTGAAGGTCTCCTGCAAGGCTTCTGGAGGCACCTTCA GCAGCTATGCTATCAGCTGGGTGCGACAGGCCCCTGGACAAGGG CTTGAGTGGATGGGAGGGATCATCCCTATCTTTGGTACAGCAAA CTACGCACAGAAGTTCCAGGGCAGAGTCACGATTACCGCGGACG AATCCACGAGCACAGCCTACATGGAGCTGAGCAGCCTGAGATCT GAGGACACGGCGGTGTACTACTGCGCCAGATTGGGCGGACGGGG |

TABLE 12-continued

SEQUENCE LISTING

| SEQ ID NO | Description | Sequence |
|---|---|---|
| | | ATACGCCGACGAGGGCTGGTACTTCGACCTATGGGGGAGAGGTA<br>CCTTGGTCACCGTCTCCTCAGCTTCCACCAAGGGCCCCTCCGTG<br>TTCCCTCTGGCCCCTTGCTCCCGGTCCACCTCCGAGTCTACCGC<br>CGCTCTGGGCTGCCTCGTGAAGGACTACTTCCCCGAGCCCGTGA<br>CCGTGTCCTGGAACTCTGGCGCCCTGACCTCCGGCGTGCACACC<br>TTCCCTGCCGTGCTGCAGTCCTCCGGCCTGTACTCCCTGTCCAG<br>CGTCGTGACCGTGCCCTCCTCCAGCCTGGGCACCAAGACCTACA<br>CCTGTAACGTGGACCACAAGCCCTCCAACACCAAAGTGGACAAG<br>CGGGTGGAATCTAAGTACGGCCCTCCCTGCCCTTCCTGCCCTGC<br>CCCTGAGTTCCTGGGCGGACCTTCCGTGTTCCTGTTCCCTCCAA<br>AGCCCAAGGACACCCTGATGATCTCCCGGACCCCTGAAGTGACC<br>TGCGTGGTGGTGGACGTGTCCCAGGAAGATCCCGAAGTCCAGTT<br>CAATTGGTACGTGGACGGCGTGGAAGTGCACAACGCCAAGACCA<br>AGCCCAGAGAGGAACAGTTCAACTCCACCTACCGGGTGGTGTCC<br>GTGCTGACCGTGCTGCACCAGGACTGGCTGAACGGCAAAGAGTA<br>CAAGTGCAAAGTGTCCAACAAGGGCCTGCCCTCCAGCATCGAAA<br>AGACCATCTCCAAGGCCAAGGGCCAGCCCCGCGAGCCCCAAGTG<br>TACACCCTGCCTCCCAGCCAGGAAGAGATGACCAAGAATCAAGT<br>GTCCCTGACTTGTCTGGTCAAGGGCTTCTACCCCTCCGATATCG<br>CCGTGGAGTGGGAGTCCAACGGCCAGCCCGAGAACAACTACAAG<br>ACCACCCCTCCCGTGCTGGACTCCGACGGCTCCTTCTTCCTGTA<br>CTCTCGGCTGACCGTGGACAAGTCCCGGTGGCAGGAAGGCAACG<br>TCTTCTCCTGCTCCGTGATGCACGAGGCCCTGCACAACCACTAC<br>ACCCAGAAGTCCCTGTCCCTGTCTCTGGGC |

SRF536-A

| 295 | HCDR1 (IMGT) | GGSFSEYY |
| 296 | HCDR2 (IMGT) | IDEVGST |
| 297 | HCDR3 (IMGT) | ARLPMYYYDSSDLPMDV |
| 298 | HCDR1 (NT) | GSFSEYYWA |
| 299 | HCDR2 (NT) | EIDEVGSTNYNPSLKS |
| 300 | HCDR3 (NT) | ARLPMYYYDSSDLPMDV |
| 301 | VH | QVQLQQWGAGLLKPSETLSLTCAVYGGSFSEYYWAWIRQPPGKG<br>LEWIGEIDEVGSTNYNPSLKSRVTISVDTSKNQFSLKLSSVTAA<br>DTAVYYCARLPMYYYDSSDLPMDVWGQGTTVTVSS |
| 302 | DNA VH | CAAGTACAATTACAACAGTGGGGAGCTGGTTTATTAAAGCCTTC<br>AGAAACTTTAAGTTTGACCTGTGCTGTTTACGGTGGATCATTTT<br>CTGAGTATTACTGGGCTTGGATTCGTCAACCACCAGGCAAAGGA<br>TTGGAGTGGATCGGTGAGATAGACGAGGTTGGCTCCACTAACTA<br>CAATCCAAGTTTAAAATCCAGGGTTACTATCTCCGTAGACACGT<br>CCAAGAACCAGTTCTCCCTGAAGCTGAGTTCTGTGACCGCCGCA<br>GACACGGCGGTGTACTACTGCGCCAGACTTCCTATGTACTACTA<br>CGACAGCAGCGACTTGCCAATGGACGTATGGGGCCAGGGAACAA<br>CTGTCACCGTCTCCTCA |
| 303 | LCDR1 (IMGT) | QDISNY |
| 304 | LCDR2 (IMGT) | DAS |
| 305 | LCDR3 (IMGT) | QQYDTLPLT |
| 306 | LCDR1 (NT) | QASQDISNYLN |
| 307 | LCDR2 (NT) | DASNLAT |
| 308 | LCDR3 (NT) | QQYDTLPLT |
| 309 | VL | DIQMTQSPSSLSASVGDRVTITCQASQDISNYLNWYQQKPGKAP<br>KLLIYDASNLATGVPSRFSGSGSGTDFTFTISSLQPEDIATYYC<br>QQYDTLPLTFGGGTKVEIK |
| 310 | DNA VL | GACATCCAGATGACCCAGTCTCCATCCTCCCTGTCTGCATCTGT<br>AGGAGACAGAGTCACCATCACTTGCCAGGCGAGTCAGGACATTA<br>GCAACTATTTAAATTGGTATCAGCAGAAACCAGGGAAAGCCCCT<br>AAGCTCCTGATCTACGATGCATCCAATTTGGCAACAGGGGTCCC<br>ATCAAGGTTCAGTGGAAGTGGATCTGGGACAGATTTTACTTTCA<br>CCATCAGCAGCCTGCAGCCTGAAGATATTGCAACATATTACTGT<br>CAGCAGTACGATACCCTCCCTCTCACTTTTGGCGGAGGGACCAA<br>GGTTGAGATCAAA |
| 311 | Heavy Chain | QVQLQQWGAGLLKPSETLSLTCAVYGGSFSEYYWAWIRQPPGKG<br>LEWIGEIDEVGSTNYNPSLKSRVTISVDTSKNQFSLKLSSVTAA<br>DTAVYYCARLPMYYYDSSDLPMDVWGQGTTVTVSSASTKGPSVF<br>PLAPSSKSTSGGTAALGCLVKDYFPEPVTVSWNSGALTSGVHTF<br>PAVLQSSGLYSLSSVVTVPSSSLGTQTYICNVNHKPSNTKVDKK<br>VEPKSCDKTHTCPPCPAPELLGGPSVFLFPPKPKDTLMISRTPE<br>VTCVVVDVSHEDPEVKFNWYVDGVEVHNAKTKPREEQYNSTYRV |

TABLE 12-continued

SEQUENCE LISTING

| SEQ ID NO | Description | Sequence |
|---|---|---|
| | | VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGK |
| 312 | DNA Heavy Chain | CAAGTACAATTACAACAGTGGGGAGCTGGTTTATTAAAGCCTTC AGAAACTTTAAGTTTGACCTGTGCTGTTTACGGTGGATCATTTT CTGAGTATTACTGGGCTTGGATTCGTCAACCACCAGGCAAAGGA TTGGAGTGGATCGGTGAGATAGACGAGGTTGGCTCCACTAACTA CAATCCAAGTTTAAAATCCAGGGTTACTATCTCCGTAGACACGT CCAAGAACCAGTTCTCCCTGAAGCTGAGTTCTGTGACCGCCGCA GACACGGCGGTGTACTACTGCGCCAGACTTCCTATGTACTACTA CGACAGCAGCGACTTGCCAATGGACGTATGGGGCCAGGGAACAA CTGTCACCGTCTCCTCAGCGAGCACCAAAGGCCCGAGCGTGTTT CCGCTGGCGCCGAGCAGCAAAAGCACCAGCGGCGGCACCGCGGC GCTGGGCTGCCTGGTGAAAGATTATTTTCCGGAACCGGTGACCG TGAGCTGGAACAGCGGCGCGCTGACCAGCGGCGTGCATACCTTT CCGGCGGTGCTGCAGAGCAGCGGCCTGTATAGCCTGAGCAGCGT GGTGACCGTGCCGAGCAGCAGCCTGGGCACCCAGACCTATATTT GCAACGTGAACCATAAACCGAGCAACACCAAAGTGGATAAAAAA GTGGAACCGAAAAGCTGCGATAAAACCCATACCTGCCCGCCGTG CCCGGCGCCGGAACTGCTGGGCGGCCCGAGCGTGTTTCTGTTTC CGCCGAAACCGAAAGATACCCTGATGATTAGCCGCACCCCGGAA GTGACCTGCGTGGTGGTGGATGTGAGCCATGAAGATCCGGAAGT GAAATTTAACTGGTATGTGGATGGCGTGGAAGTGCATAACGCGA AAACCAAACCGCGCGAAGAACAGTATAACAGCACCTATCGCGTG GTGAGCGTGCTGACCGTGCTGCATCAGGATTGGCTGAACGGCAA AGAATATAAATGCAAAGTGAGCAACAAAGCGCTGCCGGCGCCGA TTGAAAAAACCATTAGCAAAGCGAAAGGCCAGCCGCGCGAACCG CAGGTGTATACCCTGCCGCCGAGCCGCGATGAACTGACCAAAAA CCAGGTGAGCCTGACCTGCCTGGTGAAAGGCTTTTATCCGAGCG ATATTGCGGTGGAATGGGAAAGCAACGGCCAGCCGGAAAACAAC TATAAAACCACCCCGCCGGTGCTGGATAGCGATGGCAGCTTTTT TCTGTATAGCAAACTGACCGTGGATAAAAGCCGCTGGCAGCAGG GCAACGTGTTTAGCTGCAGCGTGATGCATGAAGCGCTGCATAAC CATTATACCCAGAAAAGCCTGAGCCTGAGCCCGGGCAAA |
| 313 | Light Chain | DIQMTQSPSSLSASVGDRVTITCQASQDISNYLNWYQQKPGKAP KLLIYDASNLATGVPSRFSGSGSGTDFTFTISSLQPEDIATYYC QQYDTLPLTFGGGTKVEIKRTVAAPSVFIFPPSDEQLKSGTASV VCLLNNFYPREAKVQWKVDNALQSGNSQESVTEQDSKDSTYSLS STLTLSKADYEKHKVYACEVTHQGLSSPVTKSFNRGEC |
| 314 | DNA Light Chain | GACATCCAGATGACCCAGTCTCCATCCTCCCTGTCTGCATCTGT AGGAGACAGAGTCACCATCACTTGCCAGGCGAGTCAGGACATTA GCAACTATTTAAATTGGTATCAGCAGAAACCAGGGAAAGCCCCT AAGCTCCTGATCTACGATGCATCCAATTTGGCAACAGGGGTCCC ATCAAGGTTCAGTGGAAGTGGATCTGGGACAGATTTTACTTTCA CCATCAGCAGCCTGCAGCCTGAAGATATTGCAACATATTACTGT CAGCAGTACGATACCCTTCCCTCTCACTTTTGGCGGAGGGACCAA GGTTGAGATCAAACGTACGGTGGCCGCTCCCTCCGTGTTCATCT TCCCACCCTCCGACGAGCAGCTGAAGTCCGGCACCGCCTCCGTC GTGTGCCTGCTGAACAACTTCTACCCTCGCGAGGCCAAAGTGCA GTGGAAAGTGGACAACGCCCTGCAGTCCGGCAACTCCCAGGAAT CCGTCACCGAGCAGGACTCCAAGGACAGCACCTACTCCCTGTCC TCCACCCTGACCCTGTCCAAGGCCGACTACGAGAAGCACAAAGT GTACGCCTGCGAAGTGACCCACCAGGGCCTGTCCAGCCCCGTGA CCAAGTCCTTCAACCGGGGCGAGTGC |

SRF536-B

| SEQ ID NO | Description | Sequence |
|---|---|---|
| 315 | Heavy Chain | QVQLQQWGAGLLKPSETLSLTCAVYGGSFSEYYWAWIRQPPGKG LEWIGEIDEVGSTNYNPSLKSRVTISVDTSKNQFSLKLSSVTAA DTAVYYCARLPMYYYDSSDLPMDVWGQGTTVTVSSASTKGPSVF PLAPCSRSTSESTAALGCLVKDYFPEPVTVSWNSGALTSGVHTF PAVLQSSGLYSLSSVVTVPSSSLGTKTYTCNVDHKPSNTKVDKR VESKYGPPCPSCPAPEFLGGPSVFLFPPKPKDTLMISRTPEVTC VVVDVSQEDPEVQFNWYVDGVEVHNAKTKPREEQFNSTYRVVSV LTVLHQDWLNGKEYKCKVSNKGLPSSIEKTISKAKGQPREPQVY TLPPSQEEMTKNQVSLTCLVKGFYPSDIAVEWESNGQPENNYKT TPPVLDSDGSFFLYSRLTVDKSRWQEGNVFSCSVMHEALHNHYT QKSLSLSLG |
| 316 | DNA Heavy Chain | CAAGTACAATTACAACAGTGGGGAGCTGGTTTATTAAAGCCTTC AGAAACTTTAAGTTTGACCTGTGCTGTTTACGGTGGATCATTTT CTGAGTATTACTGGGCTTGGATTCGTCAACCACCAGGCAAAGGA TTGGAGTGGATCGGTGAGATAGACGAGGTTGGCTCCACTAACTA CAATCCAAGTTTAAAATCCAGGGTTACTATCTCCGTAGACACGT CCAAGAACCAGTTCTCCCTGAAGCTGAGTTCTGTGACCGCCGCA |

TABLE 12-continued

SEQUENCE LISTING

| SEQ ID NO | Description | Sequence |
|---|---|---|
| | | GACACGGCGGTGTACTACTGCGCCAGACTTCCTATGTACTACTA |
| | | CGACAGCAGCGACTTGCCAATGGACGTATGGGGCCAGGGAACAA |
| | | CTGTCACCGTCTCCTCAGCTTCCACCAAGGGCCCCTCCGTGTTC |
| | | CCTCTGGCCCCTTGCTCCCGGTCCACCTCCGAGTCTACCGCCGC |
| | | TCTGGGCTGCCTCGTGAAGGACTACTTCCCCGAGCCCGTGACCG |
| | | TGTCCTGGAACTCTGGCGCCCTGACCTCCGGCGTGCACACCTTC |
| | | CCTGCCGTGCTGCAGTCCTCCGGCCTGTACTCCCTGTCAGCGT |
| | | CGTGACCGTGCCCTCCTCCAGCCTGGGCACCAAGACCTACACCT |
| | | GTAACGTGGACCACAAGCCCTCCAACACCAAAGTGGACAAGCGG |
| | | GTGGAATCTAAGTACGGCCCTCCCTGCCCTTCCTGCCCTGCCCC |
| | | TGAGTTCCTGGGCGGACCTTCCGTGTTCCTGTTCCCTCCAAAGC |
| | | CCAAGGACACCCTGATGATCTCCCGGACCCCTGAAGTGACCTGC |
| | | GTGGTGGTGGACGTGTCCCAGGAAGATCCCGAAGTCCAGTTCAA |
| | | TTGGTACGTGGACGGCGTGGAAGTGCACAACGCCAAGACCAAGC |
| | | CCAGAGAGGAACAGTTCAACTCCACCTACCGGGTGGTGTCCGTG |
| | | CTGACCGTGCTGCACCAGGACTGGCTGAACGGCAAAGAGTACAA |
| | | GTGCAAAGTGTCCAACAAGGGCCTGCCCTCCAGCATCGAAAGA |
| | | CCATCTCCAAGGCCAAGGGCCAGCCCCGCGAGCCCAAGTGTAC |
| | | ACCCTGCCTCCAGCCAGGAAGAGATGACCAAGAATCAAGTGTC |
| | | CCTGACTTGTCTGGTCAAGGGCTTCTACCCCTCCGATATCGCCG |
| | | TGGAGTGGGAGTCCAACGGCCAGCCCGAGAACAACTACAAGACC |
| | | ACCCCTCCCGTGCTGGACTCCGACGGCTCCTTCTTCCTGTACTC |
| | | TCGGCTGACCGTGGACAAGTCCCGGTGGCAGGAAGGCAACGTCT |
| | | TCTCCTGCTCCGTGATGCACGAGGCCCTGCACAACCACTACACC |
| | | CAGAAGTCCCTGTCCCTGTCTCTGGGC |

SRF416-A

| SEQ ID NO | Description | Sequence |
|---|---|---|
| 317 | HCDR1 (IMGT) | GGSFSGYY |
| 318 | HCDR2 (IMGT) | IDVDGST |
| 319 | HCDR3 (IMGT) | ARDGYYYDTSPYDV |
| 320 | HCDR1 (NT) | GSFSGYYWS |
| 321 | HCDR2 (NT) | EIDVDGSTNYNPSLKS |
| 322 | HCDR3 (NT) | ARDGYYYDTSPYDV |
| 323 | VH | QVQLQQWGAGLLKPSETLSLTCAVYGGSFSGYYWSWIRQPPGKG |
| | | LEWIGEIDVDGSTNYNPSLKSRVTISVDTSKNQFSLKLSSVTAA |
| | | DTAVYYCARDGYYYDTSPYDVWGQGTMVTVSS |
| 324 | DNA VH | CAAGTACAATTACAACAGTGGGGAGCTGGTTTATTAAAGCCTTC |
| | | AGAAACTTTAAGTTTGACCTGTGCTGTTTACGGTGGATCATTTT |
| | | CTGGTTATTACTGGAGTTGGATTCGTCAACCACCAGGCAAGGA |
| | | TTGGAGTGGATCGGTGAGATAGACGTGGATGGCTCCACTAACTA |
| | | CAATCCAAGTTTAAAATCCAGGGTTACTATCTCCGTAGACACGT |
| | | CCAAGAACCAGTTCTCCCTGAAGCTGAGTTCTGTGACCGCCGCA |
| | | GACACGGCGGTGTACTACTGCGCCAGAGACGGATACTACTACGA |
| | | CACCAGTCCATACGACGTATGGGGTCAGGGTACAATGGTCACCG |
| | | TCTCCTCA |
| 325 | LCDR1 (IMGT) | QSVSSY |
| 326 | LCDR2 (IMGT) | DAS |
| 327 | LCDR3 (IMGT) | QQRDSFPLT |
| 328 | LCDR1 (NT) | RASQSVSSYLA |
| 329 | LCDR2 (NT) | DASNRAT |
| 330 | LCDR3 (NT) | QQRDSFPLT |
| 331 | VL | EIVLTQSPATLSLSPGERATLSCRASQSVSSYLAWYQQKPGQAP |
| | | RLLIYDASNRATGIPARFSGSGSGTDFTLTISSLEPEDFAVYYC |
| | | QQRDSFPLTFGGGTKVEIK |
| 332 | DNA VL | GAAATTGTGTTGACACAGTCTCCAGCCACCCTGTCTTTGTCTCC |
| | | AGGGGAAAGAGCCACCCTCTCCTGCAGGGCCAGTCAGAGTGTTA |
| | | GCAGCTACTTAGCCTGGTACCAACAGAAACCTGGCCAGGCTCCC |
| | | AGGCTCCTCATCTATGATGCATCCAACAGGGCCACTGGCATCCC |
| | | AGCCAGGTTCAGTGGCAGTGGGTCTGGGACAGACTTCACTCTCA |
| | | CCATCAGCAGCCTAGAGCCTGAAGATTTTGCAGTTTATTACTGT |
| | | CAGCAGAGAGACTCCTTCCCTCTCACTTTTGGCGGAGGGACCAA |
| | | GGTTGAGATCAAA |
| 333 | Heavy Chain | QVQLQQWGAGLLKPSETLSLTCAVYGGSFSGYYWSWIRQPPGKG |
| | | LEWIGEIDVDGSTNYNPSLKSRVTISVDTSKNQFSLKLSSVTAA |
| | | DTAVYYCARDGYYYDTSPYDVWGQGTMVTVSSASTKGPSVFPLA |
| | | PSSKSTSGGTAALGCLVKDYFPEPVTVSWNSGALTSGVHTFPAV |
| | | LQSSGLYSLSSVVTVPSSSLGTQTYICNVNHKPSNTKVDKKVEP |
| | | KSCDKTHTCPPCPAPELLGGPSVFLFPPKPKDTLMISRTPEVTC |

TABLE 12-continued

SEQUENCE LISTING

| SEQ ID NO | Description | Sequence |
|---|---|---|
| | | VVVDVSHEDPEVKFNWYVDGVEVHNAKTKPREEQYNSTYRVVSV LTVLHQDWLNGKEYKCKVSNKALPAPIEKTISKAKGQPREPQVY TLPPSRDELTKNQVSLTCLVKGFYPSDIAVEWESNGQPENNYKT TPPVLDSDGSFFLYSKLTVDKSRWQQGNVFSCSVMHEALHNHYT QKSLSLSPGK |
| 334 | DNA Heavy Chain | CAAGTACAATTACAACAGTGGGGAGCTGGTTTATTAAAGCCTTC AGAAACTTTAAGTTTGACCTGTGCTGTTTACGGTGGATCATTTT CTGGTTATTACTGGAGTTGGATTCGTCAACCACCAGGCAAAGGA TTGGAGTGGATCGGTGAGATAGACGTGGATGGCTCCACTAACTA CAATCCAAGTTTAAAATCCAGGGTTACTATCTCCGTAGACACGT CCAAGAACCAGTTCTCCCTGAAGCTGAGTTCTGTGACCGCCGCA GACACGGCGGTGTACTACTGCGCCAGAGACGGATACTACTACGA CACCAGTCCATACGACGTATGGGGTCAGGGTACAATGGTCACCG TCTCCTCAGCGAGCACCAAAGGCCCGAGCGTGTTTCCGCTGGCG CCGAGCAGCAAAAGCACCAGCGGCGGCACCGCGGCGCTGGGCTG CCTGGTGAAAGATTATTTTCCGGAACCGGTGACCGTGAGCTGGA ACAGCGGCGCGCTGACCAGCGGCGTGCATACCTTTCCGGCGGTG CTGCAGAGCAGCGGCCTGTATAGCCTGAGCAGCGTGGTGACCGT GCCGAGCAGCAGCCTGGGCACCCAGACCTATATTTGCAACGTGA ACCATAAACCGAGCAACACCAAAGTGGATAAAAAAGTGGAACCG AAAAGCTGCGATAAAACCCATACCTGCCCGCCGTGCCCGGCGCC GGAACTGCTGGGCGGCCCGAGCGTGTTTCTGTTTCCGCCGAAAC CGAAAGATACCCTGATGATTAGCCGCACCCCGGAAGTGACCTGC GTGGTGGTGGATGTGAGCCATGAAGATCCGGAAGTGAAATTTAA CTGGTATGTGGATGGCGTGGAAGTGCATAACGCGAAAACCAAAC CGCGCGAAGAACAGTATAACAGCACCTATCGCGTGGTGAGCGTG CTGACCGTGCTGCATCAGGATTGGCTGAACGGCAAAGAATATAA ATGCAAAGTGAGCAACAAAGCGCTGCCGGCGCCGATTGAAAAAA CCATTAGCAAAGCGAAAGGCCAGCCGCGCGAACCGCAGGTGTAT ACCCTGCCGCCGAGCCGCGATGAACTGACCAAAAACCAGGTGAG CCTGACCTGCCTGGTGAAAGGCTTTTATCCGAGCGATATTGCGG TGGAATGGGAAAGCAACGGCCAGCCGGAAAACAACTATAAAACC ACCCCGCCGGTGCTGGATAGCGATGGCAGCTTTTTTCTGTATAG CAAACTGACCGTGGATAAAAGCCGCTGGCAGCAGGGCAACGTGT TTAGCTGCAGCGTGATGCATGAAGCGCTGCATAACCATTATACC CAGAAAAGCCTGAGCCTGAGCCCGGGCAAA |
| 335 | Light Chain | EIVLTQSPATLSLSPGERATLSCRASQSVSSYLAWYQQKPGQAP RLLIYDASNRATGIPARFSGSGSGTDFTLTISSLEPEDFAVYYC QQRDSFPLTFGGGTKVEIKRTVAAPSVFIFPPSDEQLKSGTASV VCLLNNFYPREAKVQWKVDNALQSGNSQESVTEQDSKDSTYSLS STLTLSKADYEKHKVYACEVTHQGLSSPVTKSFNRGEC |
| 336 | DNA Light Chain | GAAATTGTGTTGACACAGTCTCCAGCCACCCTGTCTTTGTCTCC AGGGGAAAGAGCCACCCTCTCCTGCAGGGCCAGTCAGAGTGTTA GCAGCTACTTAGCCTGGTACCAACAGAAACCTGGCCAGGCTCCC AGGCTCCTCATCTATGATGCATCCAACAGGGCCACTGGCATCCC AGCCAGGTTCAGTGGCAGTGGGTCTGGGACAGACTTCACTCTCA CCATCAGCAGCCTAGAGCCTGAAGATTTTGCAGTTTATTACTGT CAGCAGAGAGACTCCTTCCCTCTCACTTTTGGCGGAGGGACCAA GGTTGAGATCAAACGTACGGTGGCCGCTCCCTCCGTGTTCATCT TCCCACCCTCCGACGAGCAGCTGAAGTCCGGCACCGCCTCCGTC GTGTGCCTGCTGAACAACTTCTACCCTCGCGAGGCCAAAGTGCA GTGGAAAGTGGACAACGCCCTGCAGTCCGGCAACTCCCAGGAAT CCGTCACCGAGCAGGACTCCAAGGACAGCACCTACTCCCTGTCC TCCACCCTGACCCTGTCCAAGGCCGACTACGAGAAGCACAAAGT GTACGCCTGCGAAGTGACCCACCAGGGCCTGTCCAGCCCCGTGA CCAAGTCCTTCAACCGGGGCGAGTGC |

SRF416-B

| 337 | Heavy Chain | QVQLQQWGAGLLKPSETLSLTCAVYGGSFSGYYWSWIRQPPGKG LEWIGEIDVDGSTNYNPSLKSRVTISVDTSKNQFSLKLSSVTAA DTAVYYCARDGYYYDTSPYDVWGQGTMVTVSSASTKGPSVFPLA PCSRSTSESTAALGCLVKDYFPEPVTVSWNSGALTSGVHTFPAV LQSSGLYSLSSVVTVPSSSLGTKTYTCNVDHKPSNTKVDKRVES KYGPPCPSCPAPEFLGGPSVFLFPPKPKDTLMISRTPEVTCVVV DVSQEDPEVQFNWYVDGVEVHNAKTKPREEQFNSTYRVVSVLTV LHQDWLNGKEYKCKVSNKGLPSSIEKTISKAKGQPREPQVYTLP PSQEEMTKNQVSLTCLVKGFYPSDIAVEWESNGQPENNYKTTPP VLDSDGSFFLYSRLTVDKSRWQEGNVFSCSVMHEALHNHYTQKS LSLSLG |
| 338 | DNA Heavy Chain | CAAGTACAATTACAACAGTGGGGAGCTGGTTTATTAAAGCCTTC AGAAACTTTAAGTTTGACCTGTGCTGTTTACGGTGGATCATTTT CTGGTTATTACTGGAGTTGGATTCGTCAACCACCAGGCAAAGGA TTGGAGTGGATCGGTGAGATAGACGTGGATGGCTCCACTAACTA CAATCCAAGTTTAAAATCCAGGGTTACTATCTCCGTAGACACGT |

TABLE 12-continued

SEQUENCE LISTING

| SEQ ID NO | Description | Sequence |
|---|---|---|
| | | CCAAGAACCAGTTCTCCCTGAAGCTGAGTTCTGTGACCGCCGCA<br>GACACGGCGGTGTACTACTGCGCCAGAGACGGATACTACTACGA<br>CACCAGTCCATACGACGTATGGGGTCAGGGTACAATGGTCACCG<br>TCTCCTCAGCTTCCACCAAGGGCCCCTCCGTGTTCCCTCTGGCC<br>CCTTGCTCCCGGTCCACCTCCGAGTCTACCGCCGCTCTGGGCTG<br>CCTCGTGAAGGACTACTTCCCCGAGCCCGTGACCGTGTCCTGGA<br>ACTCTGGCGCCCTGACCTCCGGCGTGCACACCTTCCCTGCCGTG<br>CTGCAGTCCTCCGGCCTGTACTCCCTGTCCAGCGTCGTGACCGT<br>GCCCTCCTCCAGCCTGGGCACCAAGACCTACACCTGTAACGTGG<br>ACCACAAGCCCTCCAACACCAAAGTGGACAAGCGGGTGGAATCT<br>AAGTACGGCCCTCCCTGCCCTTCCTGCCCTGCCCCTGAGTTCCT<br>GGGCGGACCTTCCGTGTTCCTGTTCCCTCCAAAGCCCAAGGACA<br>CCCTGATGATCTCCCGGACCCCTGAAGTGACCTGCGTGGTGGTG<br>GACGTGTCCCAGGAAGATCCCGAAGTCCAGTTCAATTGGTACGT<br>GGACGGCGTGGAAGTGCACAACGCCAAGACCAAGCCCAGAGAGG<br>AACAGTTCAACTCCACCTACCGGGTGGTGTCCGTGCTGACCGTG<br>CTGCACCAGGACTGGCTGAACGGCAAAGAGTACAAGTGCAAAGT<br>GTCCAACAAGGGCCTGCCCTCCAGCATCGAAAGACCATCTCCA<br>AGGCCAAGGGCCAGCCCCGCGAGCCCCAAGTGTACACCCTGCCT<br>CCCAGCCAGGAAGAGATGACCAAGAATCAAGTGTCCCTGACTTG<br>TCTGGTCAAGGGCTTCTACCCCTCCGATATCGCCGTGGAGTGGG<br>AGTCCAACGGCCAGCCCGAGAACAACTACAAGACCACCCCTCCC<br>GTGCTGGACTCCGACGGCTCCTTCTTCCTGTACTCTCGGCTGAC<br>CGTGGACAAGTCCCGGTGGCAGGAAGGCAACGTCTTCTCCTGCT<br>CCGTGATGCACGAGGCCCTGCACAACCACTACACCCAGAAGTCC<br>CTGTCCCTGTCTCTGGGC |
| | SRF405-A | |
| 339 | HCDR1 (IMGT) | GGTFVGYA |
| 340 | HCDR2 (IMGT) | IIPIFGIA |
| 341 | HCDR3 (IMGT) | ARSYYSSRWHYYYYMDV |
| 342 | HCDR1 (NT) | GTFVGYAIS |
| 343 | HCDR2 (NT) | GIIPIFGIANYAQKFQG |
| 344 | HCDR3 (NT) | ARSYYSSRWHYYYYMDV |
| 345 | VH | QVQLVQSGAEVKKPGSSVKVSCKASGGTFVGYAISWVRQAPGQG<br>LEWMGGIIPIFGIANYAQKFQGRVTITADESTSTAYMELSSLRS<br>EDTAVYYCARSYYSSRWHYYYYMDVWGKGTTVTVSS |
| 346 | DNA VH | CAGGTGCAGCTGGTGCAGTCTGGGGCTGAGGTGAAGAAGCCTGG<br>GTCCTCGGTGAAGGTCTCCTGCAAGGCTTCTGGAGGCACCTTCG<br>TTGGGTATGCTATCAGCTGGGTGCGACAGGCCCCTGGACAAGGG<br>CTTGAGTGGATGGGAGGGATCATCCCTATCTTTGGTATTGCAAA<br>CTACGCACAGAAGTTCCAGGGCAGAGTCACGATTACCGCGGACG<br>AATCCACGAGCACAGCCTACATGGAGCTGAGCAGCCTGAGATCT<br>GAGGACACGGCGGTGTACTACTGCGCCAGATCTTACTACTCCAG<br>CCGATGGCACTACTACTACATGGACGTGTGGGGCAAGGGTA<br>CAACTGTCACCGTCTCCTCA |
| 347 | LCDR1 (IMGT) | QGISSW |
| 348 | LCDR2 (IMGT) | AAS |
| 349 | LCDR3 (IMGT) | QQADDLPLT |
| 350 | LCDR1 (NT) | RASQGISSWLA |
| 351 | LCDR2 (NT) | AASNLQS |
| 352 | LCDR3 (NT) | QQADDLPLT |
| 353 | VL | DIQMTQSPSSVSASVGDRVTITCRASQGISSWLAWYQQKPGKAP<br>KLLIYAASNLQSGVPSRFSGSGSGTDFTLTISSLQPEDFATYYC<br>QQADDLPLTFGGGTKVEIK |
| 354 | DNA VL | GACATCCAGATGACCCAGTCTCCATCTTCCGTGTCTGCATCTGT<br>AGGAGACAGAGTCACCATCACTTGTCGGGCGAGTCAGGGTATTA<br>GCAGCTGGTTAGCCTGGTATCAGCAGAAACCAGGGAAAGCCCCT<br>AAGCTCCTGATCTATGCTGCATCCAATTTGCAAAGTGGGGTCCC<br>ATCAAGGTTCAGCGGCAGTGGATCTGGGACAGATTTCACTCTCA<br>CCATCAGCAGCCTGCAGCCTGAAGATTTTGCAACTTATTACTGT<br>CAGCAGGCAGACGACCTCCCTCTCACTTTTGGCGGAGGGACCAA<br>GGTTGAGATCAAA |
| 355 | Heavy Chain | QVQLVQSGAEVKKPGSSVKVSCKASGGTFVGYAISWVRQAPGQG<br>LEWMGGIIPIFGIANYAQKFQGRVTITADESTSTAYMELSSLRS<br>EDTAVYYCARSYYSSRWHYYYYMDVWGKGTTVTVSSASTKGPSV<br>FPLAPSSKSTSGGTAALGCLVKDYFPEPVTVSWNSGALTSGVHT<br>FPAVLQSSGLYSLSSVVTVPSSSLGTQTYICNVNHKPSNTKVDK |

TABLE 12-continued

SEQUENCE LISTING

| SEQ ID NO | Description | Sequence |
|---|---|---|
| | | KVEPKSCDKTHTCPPCPAPELLGGPSVFLFPPKPKDTLMISRTP EVTCVVVDVSHEDPEVKFNWYVDGVEVHNAKTKPREEQYNSTYR VVSVLTVLHQDWLNGKEYKCKVSNKALPAPIEKTISKAKGQPRE PQVYTLPPSRDELTKNQVSLTCLVKGFYPSDIAVEWESNGQPEN NYKTTPPVLDSDGSFFLYSKLTVDKSRWQQGNVFSCSVMHEALH NHYTQKSLSLSPGK |
| 356 | DNA Heavy Chain | CAGGTGCAGCTGGTGCAGTCTGGGGCTGAGGTGAAGAAGCCTGG GTCCTCGGTGAAGGTCTCCTGCAAGGCTTCTGGAGGCACCTTCG TTGGGTATGCTATCAGCTGGGTGCGACAGGCCCCTGGACAAGGG CTTGAGTGGATGGGAGGGATCATCCCTATCTTTGGTATTGCAAA CTACGCACAGAAGTTCCAGGGCAGAGTCACGATTACCGCGGACG AATCCACGAGCACAGCCTACATGGAGCTGAGCAGCCTGAGATCT GAGGACACGGCGGTGTACTACTGCGCCAGATCTTACTACTCCAG CCGATGGCACTACTACTACATGGACGTGTGGGGCAAGGGTA CAACTGTCACCGTCTCCTCAGCGAGCACCAAAGGCCCGAGCGTG TTTCCGCTGGCGCCGAGCAGCAAAAGCACCAGCGGCGGCACCGC GGCGCTGGGCTGCCTGGTGAAAGATTATTTTCCGGAACCGGTGA CCGTGAGCTGGAACAGCGGCGCGCTGACCAGCGGCGTGCATACC TTTCCGGCGGTGCTGCAGAGCAGCGGCCTGTATAGCCTGAGCAG CGTGGTGACCGTGCCGAGCAGCAGCCTGGGCACCCAGACCTATA TTTGCAACGTGAACCATAAACCGAGCAACACCAAAGTGGATAAA AAAGTGGAACCGAAAAGCTGCGATAAAACCCATACCTGCCCGCC GTGCCCGGCGCCGGAACTGCTGGGCGGCCCGAGCGTGTTTCTGT TTCCGCCGAAACCGAAAGATACCCTGATGATTAGCCGCACCCCG GAAGTGACCTGCGTGGTGGTGGATGTGAGCCATGAAGATCCGGA AGTGAAATTTAACTGGTATGTGGATGGCGTGGAAGTGCATAACG CGAAAACCAAACCGCGCGAAGAACAGTATAACAGCACCTATCGC GTGGTGAGCGTGCTGACCGTGCTGCATCAGGATTGGCTGAACGG CAAAGAATATAAATGCAAAGTGAGCAACAAAGCGCTGCCGGCGC CGATTGAAAAAACCATTAGCAAAGCGAAAGGCCAGCCGCGCGAA CCGCAGGTGTATACCCTGCCGCCGAGCCGCGATGAACTGACCAA AAACCAGGTGAGCCTGACCTGCCTGGTGAAAGGCTTTTATCCGA GCGATATTGCGGTGGAATGGGAAAGCAACGGCCAGCCGGAAAAC AACTATAAAACCACCCCGCCGGTGCTGGATAGCGATGGCAGCTT TTTTCTGTATAGCAAACTGACCGTGGATAAAAGCCGCTGGCAGC AGGGCAACGTGTTTAGCTGCAGCGTGATGCATGAAGCGCTGCAT AACCATTATACCCAGAAAAGCCTGAGCCTGAGCCCGGGCAAA |
| 357 | Light Chain | DIQMTQSPSSVSASVGDRVTITCRASQGISSWLAWYQQKPGKAP KLLIYAASNLQSGVPSRFSGSGSGTDFTLTISSLQPEDFATYYC QQADDLPLTFGGGTKVEIKRTVAAPSVFIFPPSDEQLKSGTASV VCLLNNFYPREAKVQWKVDNALQSGNSQESVTEQDSKDSTYSLS STLTLSKADYEKHKVYACEVTHQGLSSPVTKSFNRGEC |
| 358 | DNA Light Chain | GACATCCAGATGACCCAGTCTCCATCTTCCGTGTCTGCATCTGT AGGAGACAGAGTCACCATCACTTGTCGGGCGAGTCAGGGTATTA GCAGCTGGTTAGCCTGGTATCAGCAGAAACCAGGGAAAGCCCCT AAGCTCCTGATCTATGCTGCATCCAATTTGCAAAGTGGGGTCCC ATCAAGGTTCAGCGGCAGTGGATCTGGGACAGATTTCACTCTCA CCATCAGCAGCCTGCAGCCTGAAGATTTTGCAACTTATTACTGT CAGCAGGCAGACGACCTCCCTCTCACTTTTGGCGGAGGGACCAA GGTTGAGATCAAACGTACGGTGGCCGCTCCCTCCGTGTTCATCT TCCCACCCTCCGACGAGCAGCTGAAGTCCGGCACCGCCTCCGTC GTGTGCCTGCTGAACAACTTCTACCCTCGCGAGGCCAAAGTGCA GTGGAAAGTGGACAACGCCCTGCAGTCCGGCAACTCCCAGGAAT CCGTCACCGAGCAGGACTCCAAGGACAGCACCTACTCCCTGTCC TCCACCCTGACCCTGTCCAAGGCCGACTACGAGAAGCACAAAGT GTACGCCTGCGAAGTGACCCACCAGGGCCTGTCCAGCCCCGTGA CCAAGTCCTTCAACCGGGGCGAGTGC |

SRF405-B

| 359 | Heavy Chain | QVQLVQSGAEVKKPGSSVKVSCKASGGTFVGYAISWVRQAPGQG LEWMGGIIPIFGIANYAQKFQGRVTITADESTSTAYMELSSLRS EDTAVYYCARSYYSSRWHYYYYMDVWGKGTTVTVSSASTKGPSV FPLAPCSRSTSESTAALGCLVKDYFPEPVTVSWNSGALTSGVHT FPAVLQSSGLYSLSSVVTVPSSSLGTKTYTCNVDHKPSNTKVDK RVESKYGPPCPSCPAPEFLGGPSVFLFPPKPKDTLMISRTPEVT CVVVDVSQEDPEVQFNWYVDGVEVHNAKTKPREEQFNSTYRVVS VLTVLHQDWLNGKEYKCKVSNKGLPSSIEKTISKAKGQPREPQV YTLPPSQEEMTKNQVSLTCLVKGFYPSDIAVEWESNGQPENNYK TTPPVLDSDGSFFLYSRLTVDKSRWQEGNVFSCSVMHEALHNHY TQKSLSLSLG |
| 360 | DNA Heavy Chain | CAGGTGCAGCTGGTGCAGTCTGGGGCTGAGGTGAAGAAGCCTGG GTCCTCGGTGAAGGTCTCCTGCAAGGCTTCTGGAGGCACCTTCG TTGGGTATGCTATCAGCTGGGTGCGACAGGCCCCTGGACAAGGG CTTGAGTGGATGGGAGGGATCATCCCTATCTTTGGTATTGCAAA |

TABLE 12-continued

SEQUENCE LISTING

| SEQ ID NO | Description | Sequence |
|---|---|---|
| | | CTACGCACAGAAGTTCCAGGGCAGAGTCACGATTACCGCGGACG<br>AATCCACGAGCACAGCCTACATGGAGCTGAGCAGCCTGAGATCT<br>GAGGACACGGCGGTGTACTACTGCGCCAGATCTTACTACTCCAG<br>CCGATGGCACTACTACTACTACATGGACGTGTGGGGCAAGGGTA<br>CAACTGTCACCGTCTCCTCAGCTTCCACCAAGGGCCCCTCCGTG<br>TTCCCTCTGGCCCCTTGCTCCCGGTCCACCTCCGAGTCTACCGC<br>CGCTCTGGGCTGCCTCGTGAAGGACTACTTCCCCGAGCCCGTGA<br>CCGTGTCCTGGAACTCTGGCGCCCTGACCTCCGGCGTGCACACC<br>TTCCCTGCCGTGCTGCAGTCCTCCGGCCTGTACTCCCTGTCCAG<br>CGTCGTGACCGTGCCCTCCTCCAGCCTGGGCACCAAGACCTACA<br>CCTGTAACGTGGACCACAAGCCCTCCAACACCAAAGTGGACAAG<br>CGGGTGGAATCTAAGTACGGCCCTCCCTGCCCTTCCTGCCCTGC<br>CCCTGAGTTCCTGGGCGGACCTTCCGTGTTCCTGTTCCCTCCAA<br>AGCCCAAGGACACCCTGATGATCTCCCGGACCCCTGAAGTGACC<br>TGCGTGGTGGTGGACGTGTCCCAGGAAGATCCCGAAGTCCAGTT<br>CAATTGGTACGTGGACGGCGTGGAAGTGCACAACGCCAAGACCA<br>AGCCCAGAGAGGAACAGTTCAACTCCACCTACCGGGTGGTGTCC<br>GTGCTGACCGTGCTGCACCAGGACTGGCTGAACGGCAAAGAGTA<br>CAAGTGCAAAGTGTCCAACAAGGGCCTGCCCTCCAGCATCGAAA<br>AGACCATCTCCAAGGCCAAGGGCCAGCCCCGCGAGCCCCAAGTG<br>TACACCCTGCCTCCCAGCCAGGAAGAGATGACCAAGAATCAAGT<br>GTCCCTGACTTGTCTGGTCAAGGGCTTCTACCCCTCCGATATCG<br>CCGTGGAGTGGGAGTCCAACGGCCAGCCCGAGAACAACTACAAG<br>ACCACCCCTCCCGTGCTGGACTCCGACGGCTCCTTCTTCCTGTA<br>CTCTCGGCTGACCGTGGACAAGTCCCGGTGGCAGGAAGGCAACG<br>TCTTCTCCTGCTCCGTGATGCACGAGGCCCTGCACAACCACTAC<br>ACCCAGAAGTCCCTGTCCCTGTCTCTGGGC |

SRF535-A

| SEQ ID NO | Description | Sequence |
|---|---|---|
| 361 | HCDR1 (IMGT) | GFTFSSYG |
| 362 | HCDR2 (IMGT) | IKQDGSEK |
| 363 | HCDR3 (IMGT) | ARDAPWDIYDYYMDV |
| 364 | HCDR1 (NT) | FTFSSYGMS |
| 365 | HCDR2 (NT) | NIKQDGSEKYYVDSVKG |
| 366 | HCDR3 (NT) | ARDAPWDIYDYYMDV |
| 367 | VH | EVQLVESGGGLVQPGGSLRLSCAASGFTFSSYGMSWVRQAPGKG<br>LEWVANIKQDGSEKYYVDSVKGRFTISRDNAKNSLYLQMNSLRA<br>EDTAVYYCARDAPWDIYDYYMDVWGKGTTVTVSS |
| 368 | DNA VH | GAGGTGCAGCTGGTGGAGTCTGGGGGAGGCTTGGTCCAGCCTGG<br>GGGGTCCCTGAGACTCTCCTGTGCAGCCTCTGGATTCACCTTTA<br>GTAGCTATGGGATGAGCTGGGTCCGCCAGGCTCCAGGGAAGGGG<br>CTGGAGTGGGTGGCCAACATAAAGCAAGATGGAAGTGAGAAATA<br>CTATGTGGACTCTGTGAAGGGCCGATTCACCATCTCCAGAGACA<br>ACGCCAAGAACTCACTGTATCTGCAAATGAACAGCCTGAGAGCC<br>GAGGACACGGCGGTGTACTACTGCGCCAGAGATGCTCCTTGGGA<br>CATCTACGACTACTACATGGACGTATGGGGCAAGGGTACAACTG<br>TCACCGTCTCCTCA |
| 369 | LCDR1 (IMGT) | QSISSY |
| 370 | LCDR2 (IMGT) | AAS |
| 371 | LCDR3 (IMGT) | QQSYVPPWT |
| 372 | LCDR1 (NT) | RASQSISSYLN |
| 373 | LCDR2 (NT) | AASSLQS |
| 374 | LCDR3 (NT) | QQSYVPPWT |
| 375 | VL | DIQMTQSPSSLSASVGDRVTITCRASQSISSYLNWYQQKPGKAP<br>KLLIYAASSLQSGVPSRFSGSGSGTDFTLTISSLQPEDFATYYC<br>QQSYVPPWTFGGGTKVEIK |
| 376 | DNA VL | GACATCCAGATGACCCAGTCTCCATCCTCCCTGTCTGCATCTGT<br>AGGAGACAGAGTCACCATCACTTGCCGGGCAAGTCAGAGCATTA<br>GCAGCTATTTAAATTGGTATCAGCAGAAACCAGGGAAAGCCCT<br>AAGCTCCTGATCTATGCTGCATCCAGTTTGCAAAGTGGGGTCCC<br>ATCAAGGTTCAGTGGCAGTGGATCTGGGACAGATTTCACTCTCA<br>CCATCAGCAGTCTGCAACCTGAAGATTTTGCAACTTACTACTGT<br>CAGCAAAGCTACGTTCCCCCCTTGGACTTTTGGCGGAGGGACCAA<br>GGTTGAGATCAAA |
| 377 | Heavy Chain | EVQLVESGGGLVQPGGSLRLSCAASGFTFSSYGMSWVRQAPGKG<br>LEWVANIKQDGSEKYYVDSVKGRFTISRDNAKNSLYLQMNSLRA<br>EDTAVYYCARDAPWDIYDYYMDVWGKGTTVTVSSASTKGPSVFP<br>LAPSSKSTSGGTAALGCLVKDYFPEPVTVSWNSGALTSGVHTFP |

TABLE 12-continued

SEQUENCE LISTING

| SEQ ID NO | Description | Sequence |
|---|---|---|
|  |  | AVLQSSGLYSLSSVVTVPSSSLGTQTYICNVNHKPSNTKVDKKV EPKSCDKTHTCPPCPAPELLGGPSVFLFPPKPKDTLMISRTPEV TCVVVDVSHEDPEVKFNWYVDGVEVHNAKTKPREEQYNSTYRVV SVLTVLHQDWLNGKEYKCKVSNKALPAPIEKTISKAKGQPREPQ VYTLPPSRDELTKNQVSLTCLVKGFYPSDIAVEWESNGQPENNY KTTPPVLDSDGSFFLYSKLTVDKSRWQQGNVFSCSVMHEALHNH YTQKSLSLSPGK |
| 378 | DNA Heavy Chain | GAGGTGCAGCTGGTGGAGTCTGGGGGAGGCTTGGTCCAGCCTGG GGGGTCCCTGAGACTCTCCTGTGCAGCCTCTGGATTCACCTTTA GTAGCTATGGGATGAGCTGGGTCCGCCAGGCTCCAGGGAAGGGG CTGGAGTGGGTGGCCAACATAAAGCAAGATGGAAGTGAGAAATA CTATGTGGACTCTGTGAAGGGCCGATTCACCATCTCCAGAGACA ACGCCAAGAACTCACTGTATCTGCAAATGAACAGCCTGAGAGCC GAGGACACGGCGGTGTACTACTGCGCCAGAGATGCTCCTTGGGA CATCTACGACTACTACATGGACGTATGGGGCAAGGGTACAACTG TCACCGTCTCCTCAGCGAGCACCAAAGGCCCGAGCGTGTTTCCG CTGGCGCCGAGCAGCAAAAGCACCAGCGGCGGCACCGCGGCGCT GGGCTGCCTGGTGAAAGATTATTTTCCGGAACCGGTGACCGTGA GCTGGAACAGCGGCGCGCTGACCAGCGGCGTGCATACCTTTCCG GCGGTGCTGCAGAGCAGCGGCCTGTATAGCCTGAGCAGCGTGGT GACCGTGCCGAGCAGCAGCCTGGGCACCCAGACCTATATTTGCA ACGTGAACCATAAACCGAGCAACACCAAAGTGGATAAAAAAGTG GAACCGAAAAGCTGCGATAAAACCCATACCTGCCCGCCGTGCCC GGCGCCGGAACTGCTGGGCGGCCCGAGCGTGTTTCTGTTTCCGC CGAAACCGAAAGATACCCTGATGATTAGCCGCACCCCGGAAGTG ACCTGCGTGGTGGTGGATGTGAGCCATGAAGATCCGGAAGTGAA ATTTAACTGGTATGTGGATGGCGTGGAAGTGCATAACGCGAAAA CCAAACCGCGCGAAGAACAGTATAACAGCACCTATCGCGTGGTG AGCGTGCTGACCGTGCTGCATCAGGATTGGCTGAACGGCAAAGA ATATAAATGCAAAGTGAGCAACAAAGCGCTGCCGGCGCCGATTG AAAAAACCATTAGCAAAGCGAAAGGCCAGCCGCGCGAACCGCAG GTGTATACCCTGCCGCCGAGCCGCGATGAACTGACCAAAAACCA GGTGAGCCTGACCTGCCTGGTGAAAGGCTTTTATCCGAGCGATA TTGCGGTGGAATGGGAAAGCAACGGCCAGCCGGAAAACAACTAT AAAACCACCCCGCCGGTGCTGGATAGCGATGGCAGCTTTTTTCT GTATAGCAAACTGACCGTGGATAAAAGCCGCTGGCAGCAGGGCA ACGTGTTTAGCTGCAGCGTGATGCATGAAGCGCTGCATAACCAT TATACCCAGAAAAGCCTGAGCCTGAGCCCGGGCAAA |
| 379 | Light Chain | DIQMTQSPSSLSASVGDRVTITCRASQSISSYLNWYQQKPGKAP KLLIYAASSLQSGVPSRFSGSGSGTDFTLTISSLQPEDFATYYC QQSYVPPWTFGGGTKVEIKRTVAAPSVFIFPPSDEQLKSGTASV VCLLNNFYPREAKVQWKVDNALQSGNSQESVTEQDSKDSTYSLS STLTLSKADYEKHKVYACEVTHQGLSSPVTKSFNRGEC |
| 380 | DNA Light Chain | GACATCCAGATGACCCAGTCTCCATCCTCCCTGTCTGCATCTGT AGGAGACAGAGTCACCATCACTTGCCGGGCAAGTCAGAGCATTA GCAGCTATTTAAATTGGTATCAGCAGAAACCAGGGAAAGCCCCT AAGCTCCTGATCTATGCTGCATCCAGTTTGCAAAGTGGGGTCCC ATCAAGGTTCAGTGGCAGTGGATCTGGGACAGATTTCACTCTCA CCATCAGCAGTCTGCAACCTGAAGATTTTGCAACTTACTACTGT CAGCAAAGCTACGTCCCCCCTTGGACTTTTGGCGGAGGGACCAA GGTTGAGATCAAACGTACGGTGGCCGCTCCCTCCGTGTTCATCT TCCCACCCTCCGACGAGCAGCTGAAGTCCGGCACCGCCTCCGTC GTGTGCCTGCTGAACAACTTCTACCCTCGCGAGGCCAAAGTGCA GTGGAAAGTGGACAACGCCCTGCAGTCCGGCAACTCCCAGGAAT CCGTCACCGAGCAGGACTCCAAGGACAGCACCTACTCCCTGTCC TCCACCCTGACCCTGTCCAAGGCCGACTACGAGAAGCACAAAGT GTACGCCTGCGAAGTGACCCACCAGGGCCTGTCCAGCCCCGTGA CCAAGTCCTTCAACCGGGGCGAGTGC |

SRF535-B

| 381 | Heavy Chain | EVQLVESGGGLVQPGGSLRLSCAASGFTFSSYGMSWVRQAPGKG LEWVANIKQDGSEKYYVDSVKGRFTISRDNAKNSLYLQMNSLRA EDTAVYYCARDAPWDIYDYYMDVWGKGTTVTVSSASTKGPSVFP LAPCSRSTSESTAALGCLVKDYFPEPVTVSWNSGALTSGVHTFP AVLQSSGLYSLSSVVTVPSSSLGTKTYTCNVDHKPSNTKVDKRV ESKYGPPCPSCPAPEFLGGPSVFLFPPKPKDTLMISRTPEVTCV VVDVSQEDPEVQFNWYVDGVEVHNAKTKPREEQFNSTYRVVSVL TVLHQDWLNGKEYKCKVSNKGLPSSIEKTISKAKGQPREPQVYT LPPSQEEMTKNQVSLTCLVKGFYPSDIAVEWESNGQPENNYKTT PPVLDSDGSFFLYSRLTVDKSRWQEGNVFSCSVMHEALHNHYTQ KSLSLSLG |

TABLE 12-continued

SEQUENCE LISTING

| SEQ ID NO | Description | Sequence |
|---|---|---|
| 382 | DNA Heavy Chain | GAGGTGCAGCTGGTGGAGTCTGGGGGAGGCTTGGTCCAGCCTGG
GGGGTCCCTGAGACTCTCCTGTGCAGCCTCTGGATTCACCTTTA
GTAGCTATGGGATGAGCTGGGTCCGCCAGGCTCCAGGGAAGGGG
CTGGAGTGGGTGGCCAACATAAAGCAAGATGGAAGTGAGAAATA
CTATGTGGACTCTGTGAAGGGCCGATTCACCATCTCCAGAGACA
ACGCCAAGAACTCACTGTATCTGCAAATGAACAGCCTGAGAGCC
GAGGACACGGCGGTGTACTACTGCGCCAGAGATGCTCCTTGGGA
CATCTACGACTACTACATGGACGTATGGGGCAAGGGTACAACTG
TCACCGTCTCCTCAGCTTCCACCAAGGGCCCCTCCGTGTTCCCT
CTGGCCCCTTGCTCCCGGTCCACCTCCGAGTCTACCGCCGCTCT
GGGCTGCCTCGTGAAGGACTACTTCCCCGAGCCCGTGACCGTGT
CCTGGAACTCTGGCGCCCTGACCTCCGGCGTGCACACCTTCCGT
GCCGTGCTGCAGTCCTCCGGCCTGTACTCCCTGTCCAGCGTCGT
GACCGTGCCCTCCTCCAGCCTGGGCACCAAGACCTACACCTGTA
ACGTGGACCACAAGCCCTCCAACACCAAAGTGGACAAGCGGGTG
GAATCTAAGTACGGCCCTCCCTGCCCTTCCTGCCCTGCCCCTGA
GTTCCTGGGCGGACCTTCCGTGTTCCTGTTCCCTCCAAAGCCCA
AGGACACCCTGATGATCTCCCGGACCCCTGAAGTGACCTGCGTG
GTGGTGGACGTGTCCCAGGAAGATCCCGAAGTCCAGTTCAATTG
GTACGTGGACGGCGTGGAAGTGCACAACGCCAAGACCAAGCCTA
GAGAGGAACAGTTCAACTCCACCTACCGGGTGGTGTCCGTGCTG
ACCGTGCTGCACCAGGACTGGCTGAACGGCAAAGAGTACAAGTG
CAAAGTGTCCAACAAGGGCCTGCCCTCCAGCATCGAAAAGACCA
TCTCCAAGGCCAAGGGCCAGCCCCGCGAGCCCCAAGTGTACACC
CTGCCTCCCAGCCAGGAAGAGATGACCAAGAATCAAGTGTCCCT
GACTTGTCTGGTCAAGGGCTTCTACCCCTCCGATATCGCCGTGG
AGTGGGAGTCCAACGGCCAGCCCGAGAACAACTACAAGACCACC
CCTCCCGTGCTGGACTCCGACGGCTCCTTCTTCCTGTACTCTCG
GCTGACCGTGGACAAGTCCCGGTGGCAGGAAGGCAACGTCTTCT
CCTGCTCCGTGATGCACGAGGCCCTGCACAACCACTACACCCAG
AAGTCCCTGTCCCTGTCTCTGGGC |

SRF538-A

| SEQ ID NO | Description | Sequence |
|---|---|---|
| 383 | HCDR1 (IMGT) | GFTFSSYG |
| 384 | HCDR2 (IMGT) | IWYDGSNK |
| 385 | HCDR3 (IMGT) | ARGAPEYVDV |
| 386 | HCDR1 (NT) | FTFSSYGMH |
| 387 | HCDR2 (NT) | VIWYDGSNKYYADSVKG |
| 388 | HCDR3 (NT) | ARGAPEYVDV |
| 389 | VH | QVQLVESGGGVVQPGRSLRLSCAASGFTFSSYGMHWVRQAPGKG
LEWVAVIWYDGSNKYYADSVKGRFTISRDNSKNTLYLQMNSLRA
EDTAVYYCARGAPEYVDVWGQGTMVTVSS |
| 390 | DNA VH | CAGGTGCAGCTGGTGGAGTCTGGGGGAGGCGTGGTCCAGCCTGG
GAGGTCCCTGAGACTCTCCTGTGCAGCGTCTGGATTCACCTTCA
GTAGCTATGGCATGCACTGGGTCCGCCAGGCTCCAGGCAAGGGG
CTGGAGTGGGTGGCAGTTATATGGTATGATGGAAGTAATAAATA
CTATGCAGACTCCGTGAAGGGCCGATTCACCATCTCCAGAGACA
ATTCCAAGAACACGCTGTATCTGCAAATGAACAGCCTGAGAGCC
GAGGACACGGCGGTGTACTACTGCGCCAGAGGGGCCCCTGAATA
TGTAGACGTATGGGGTCAGGGTACAATGGTCACCGTCTCCTCA |
| 391 | LCDR1 (IMGT) | QSVSSY |
| 392 | LCDR2 (IMGT) | DSS |
| 393 | LCDR3 (IMGT) | QQYSLYPT |
| 394 | LCDR1 (NT) | RASQSVSSYLA |
| 395 | LCDR2 (NT) | DSSNRAT |
| 396 | LCDR3 (NT) | QQYSLYPT |
| 397 | VL | EIVLTQSPATLSLSPGERATLSCRASQSVSSYLAWYQQKPGQAP
RLLIYDSSNRATGIPARFSGSGSGTDFTLTISSLEPEDFAVYYC
QQYSLYPTFGGGTKVEIK |
| 398 | DNA VL | GAAATTGTGTTGACACAGTCTCCAGCCACCCTGTCTTTGTCTCC
AGGGGAAAGAGCCACCCTCTCCTGCAGGGCCAGTCAGAGTGTTA
GCAGCTACTTAGCCTGGTACCAACAGAAACCTGGCCAGGCTCCC
AGGCTCCTCATCTATGATTCATCCAACAGGGCCACTGGCATCCC
AGCCAGGTTCAGTGGCAGTGGGTCTGGGACAGACTTCACTCTCA
CCATCAGCAGCCTAGAGCCTGAAGATTTTGCAGTTTATTACTGT
CAGCAGTACAGTCTCTACCCTACTTTTGGCGGAGGGACCAAGGT
TGAGATCAAA |

TABLE 12-continued

SEQUENCE LISTING

| SEQ ID NO | Description | Sequence |
|---|---|---|
| 399 | Heavy Chain | QVQLVESGGGVVQPGRSLRLSCAASGFTFSSYGMHWVRQAPGKG<br>LEWVAVIWYDGSNKYYADSVKGRFTISRDNSKNTLYLQMNSLRA<br>EDTAVYYCARGAPEYVDVWGQGTMVTVSSASTKGPSVFPLAPSS<br>KSTSGGTAALGCLVKDYFPEPVTVSWNSGALTSGVHTFPAVLQS<br>SGLYSLSSVVTVPSSSLGTQTYICNVNHKPSNTKVDKKVEPKSC<br>DKTHTCPPCPAPELLGGPSVFLFPPKPKDTLMISRTPEVTCVVV<br>DVSHEDPEVKFNWYVDGVEVHNAKTKPREEQYNSTYRVVSVLTV<br>LHQDWLNGKEYKCKVSNKALPAPIEKTISKAKGQPREPQVYTLP<br>PSRDELTKNQVSLTCLVKGFYPSDIAVEWESNGQPENNYKTTPP<br>VLDSDGSFFLYSKLTVDKSRWQQGNVFSCSVMHEALHNHYTQKS<br>LSLSPGK |
| 400 | DNA Heavy Chain | CAGGTGCAGCTGGTGGAGTCTGGGGGAGGCGTGGTCCAGCCTGG<br>GAGGTCCCTGAGACTCTCCTGTGCAGCGTCTGGATTCACCTTCA<br>GTAGCTATGGCATGCACTGGGTCCGCCAGGCTCCAGGCAAGGGG<br>CTGGAGTGGGTGGCAGTTATATGGTATGATGGAAGTAATAAATA<br>CTATGCAGACTCCGTGAAGGGCCGATTCACCATCTCCAGAGACA<br>ATTCCAAGAACACGCTGTATCTGCAAATGAACAGCCTGAGAGCC<br>GAGGACACGGCGGTGTACTACTGCGCCAGAGGGGCCCCTGAATA<br>TGTAGACGTATGGGGTCAGGGTACAATGGTCACCGTCTCCTCAG<br>CGAGCACCAAAGGCCCGAGCGTGTTTCCGCTGGCGCCGAGCAGC<br>AAAAGCACCAGCGGCGGCACCGCGGCGCTGGGCTGCCTGGTGAA<br>AGATTATTTTCCGGAACCGGTGACCGTGAGCTGGAACAGCGGCG<br>CGCTGACCAGCGGCGTGCATACCTTTCCGGCGGTGCTGCAGAGC<br>AGCGGCCTGTATAGCCTGAGCAGCGTGGTGACCGTGCCGAGCAG<br>CAGCCTGGGCACCCAGACCTATATTTGCAACGTGAACCATAAAC<br>CGAGCAACACCAAAGTGGATAAAAAAGTGGAACCGAAAAGCTGC<br>GATAAAACCCATACCTGCCCGCCGTGCCCGGCGCCGGAACTGCT<br>GGGCGGCCCGAGCGTGTTTCTGTTTCCGCCGAAACCGAAAGATA<br>CCCTGATGATTAGCCGCACCCCGGAAGTGACCTGCGTGGTGGTG<br>GATGTGAGCCATGAAGATCCGGAAGTGAAATTTAACTGGTATGT<br>GGATGGCGTGGAAGTGCATAACGCGAAAACCAAACCGCGCGAAG<br>AACAGTATAACAGCACCTATCGCGTGGTGAGCGTGCTGACCGTG<br>CTGCATCAGGATTGGCTGAACGGCAAAGAATATAAATGCAAAGT<br>GAGCAACAAAGCGCTGCCGGCGCCGATTGAAAAAACCATTAGCA<br>AAGCGAAAGGCCAGCCGCGCGAACCGCAGGTGTATACCCTGCCG<br>CCGAGCCGCGATGAACTGACCAAAAACCAGGTGAGCCTGACCTG<br>CCTGGTGAAAGGCTTTTATCCGAGCGATATTGCGGTGGAATGGG<br>AAAGCAACGGCCAGCCGGAAAACAACTATAAAACCACCCCGCCG<br>GTGCTGGATAGCGATGGCAGCTTTTTTCTGTATAGCAAACTGAC<br>CGTGGATAAAAGCCGCTGGCAGCAGGGCAACGTGTTTAGCTGCA<br>GCGTGATGCATGAAGCGCTGCATAACCATTATACCCAGAAAAGC<br>CTGAGCCTGAGCCCGGGCAAA |
| 401 | Light Chain | EIVLTQSPATLSLSPGERATLSCRASQSVSSYLAWYQQKPGQAP<br>RLLIYDSSNRATGIPARFSGSGSGTDFTLTISSLEPEDFAVYYC<br>QQYSLYPTFGGGTKVEIKRTVAAPSVFIFPPSDEQLKSGTASVV<br>CLLNNFYPREAKVQWKVDNALQSGNSQESVTEQDSKDSTYSLSS<br>TLTLSKADYEKHKVYACEVTHQGLSSPVTKSFNRGEC |
| 402 | DNA Light Chain | GAAATTGTGTTGACACAGTCTCCAGCCACCCTGTCTTTGTCTCC<br>AGGGGAAAGAGCCACCCTCTCCTGCAGGGCCAGTCAGAGTGTTA<br>GCAGCTACTTAGCCTGGTACCAACAGAAACCTGGCCAGGCTCCC<br>AGGCTCCTCATCTATGATTCATCCAACAGGGCCACTGGCATCCC<br>AGCCAGGTTCAGTGGCAGTGGGTCTGGGACAGACTTCACTCTCA<br>CCATCAGCAGCCTAGAGCCTGAAGATTTTGCAGTTTATTACTGT<br>CAGCAGTACAGTCTCTACCCTACTTTTGGCGGAGGGACCAAGGT<br>TGAGATCAAACGTACGGTGGCCGCTCCCTCCGTGTTCATCTTCC<br>CACCCTCCGACGAGCAGCTGAAGTCCGGCACCGCCTCCGTCGTG<br>TGCCTGCTGAACAACTTCTACCCTCGCGAGGCCAAAGTGCAGTG<br>GAAAGTGGACAACGCCCTGCAGTCCGGCAACTCCCAGGAATCCG<br>TCACCGAGCAGGACTCCAAGGACAGCACCTACTCCCTGTCCTCC<br>ACCCTGACCCTGTCCAAGGCCGACTACGAGAAGCACAAAGTGTA<br>CGCCTGCGAAGTGACCCACCAGGGCCTGTCCAGCCCCGTGACCA<br>AGTCCTTCAACCGGGGCGAGTGC |

SRF538-B

| 403 | Heavy Chain | QVQLVESGGGVVQPGRSLRLSCAASGFTFSSYGMHWVRQAPGKG<br>LEWVAVIWYDGSNKYYADSVKGRFTISRDNSKNTLYLQMNSLRA<br>EDTAVYYCARGAPEYVDVWGQGTMVTVSSASTKGPSVFPLAPCS<br>RSTSESTAALGCLVKDYFPEPVTVSWNSGALTSGVHTFPAVLQS<br>SGLYSLSSVVTVPSSSLGTKTYTCNVDHKPSNTKVDKRVESKYG<br>PPCPSCPAPEFLGGPSVFLFPPKPKDTLMISRTPEVTCVVVDVS<br>QEDPEVQFNWYVDGVEVHNAKTKPREEQFNSTYRVVSVLTVLHQ<br>DWLNGKEYKCKVSNKGLPSSIEKTISKAKGQPREPQVYTLPPSQ |

TABLE 12-continued

SEQUENCE LISTING

| SEQ ID NO | Description | Sequence |
|---|---|---|
| | | EEMTKNQVSLTCLVKGFYPSDIAVEWESNGQPENNYKTTPPVLD<br>SDGSFFLYSRLTVDKSRWQEGNVFSCSVMHEALHNHYTQKSLSL<br>SLG |
| 404 | DNA Heavy Chain | CAGGTGCAGCTGGTGGAGTCTGGGGGAGGCGTGGTCCAGCCTGG<br>GAGGTCCCTGAGACTCTCCTGTGCAGCGTCTGGATTCACCTTCA<br>GTAGCTATGGCATGCACTGGGTCCGCCAGGCTCCAGGCAAGGGG<br>CTGGAGTGGGTGGCAGTTATATGGTATGATGGAAGTAATAAATA<br>CTATGCAGACTCCGTGAAGGGCCGATTCACCATCTCCAGAGACA<br>ATTCCAAGAACACGCTGTATCTGCAAATGAACAGCCTGAGAGCC<br>GAGGACACGGCGGTGTACTACTGCGCCAGAGGGGCCCCTGAATA<br>TGTAGACGTATGGGGTCAGGGTACAATGGTCACCGTCTCCTCAG<br>CTTCCACCAAGGGCCCCTCCGTGTTCCCTCTGGCCCCTTGCTCC<br>CGGTCCACCTCCGAGTCTACCGCCGCTCTGGGCTGCCTCGTGAA<br>GGACTACTTCCCCGAGCCCGTGACCGTGTCCTGGAACTCTGGCG<br>CCCTGACCTCCGGCGTGCACACCTTCCCTGCCGTGCTGCAGTCC<br>TCCGGCCTGTACTCCCTGTCCAGCGTCGTGACCGTGCCCTCCTC<br>CAGCCTGGGCACCAAGACCTACACCTGTAACGTGGACCACAAGC<br>CCTCCAACACCAAAGTGGACAAGCGGGTGGAATCTAAGTACGGC<br>CCTCCCTGCCCTTCCTGCCCTGCCCCTGAGTTCCTGGGCGGACC<br>TTCCGTGTTCCTGTTCCCTCCAAAGCCCAAGGACACCCTGATGA<br>TCTCCCGGACCCCTGAAGTGACCTGCGTGGTGGTGGACGTGTCC<br>CAGGAAGATCCCGAAGTCCAGTTCAATTGGTACGTGGACGGCGT<br>GGAAGTGCACAACGCCAAGACCAAGCCCAGAGAGGAACAGTTCA<br>ACTCCACCTACCGGGTGGTGTCCGTGCTGACCGTGCTGCACCAG<br>GACTGGCTGAACGGCAAAGAGTACAAGTGCAAAGTGTCCAACAA<br>GGGCCTGCCCTCCAGCATCGAAAAGACCATCTCCAAGGCCAAGG<br>GCCAGCCCCGCGAGCCCCAAGTGTACACCCTGCCTCCCAGCCAG<br>GAAGAGATGACCAAGAATCAAGTGTCCCTGACTTGTCTGGTCGTA<br>GGGCTTCTACCCCTCCGATATCGCCGTGGAGTGGGAGTCCAACG<br>GCCAGCCCGAGAACAACTACAAGACCACCCCTCCCGTGCTGGAC<br>TCCGACGGCTCCTTCTTCCTGTACTCTCGGCTGACCGTGGACAA<br>GTCCCGGTGGCAGGAAGGCAACGTCTTCTCCTGCTCCGTGATGC<br>ACGAGGCCCTGCACAACCACTACACCCAGAAGTCCCTGTCCCTG<br>TCTCTGGGC |
| 405 | FLAG | DYKDDDDK |
| 406 | 6-HIS | HHHHHH |
| 407 | HA | YPYDVPDYA |

SRF605-A

| SEQ ID NO | Description | Sequence |
|---|---|---|
| 706 | HCDR1 (IMGT) | GGSISSGGYY |
| 707 | HCDR2 (IMGT) | IYYSGST |
| 708 | HCDR3 (IMGT) | ARDGVYQPGAYY |
| 709 | HCDR1 (ADI) | GSISSGGYYWS |
| 710 | HCDR2 (ADI) | NIYYSGSTYYNPSLKS |
| 711 | HCDR3 (ADI) | ARDGVYQPGAYY |
| 712 | VH | QVQLQESGPGLVKPSQTLSLTCTVSGGSISSGGYYWSWIRQHPG<br>KGLEWIGNIYYSGSTYYNPSLKSRVTISVDTSKNQFSLKLSSVT<br>AADTAVYYCARDGVYQPGAYYWGQGTLVTVSS |
| 713 | DNA VH | CAGGTGCAGCTGCAGGAGTCGGGCCCAGGACTGGTGAAGCCTTC<br>ACAGACCCTGTCCCTCACCTGTACTGTCTCTGGTGGCTCCATCA<br>GCAGTGGTGGTTACTACTGGAGCTGGATCCGCCAGCACCCAGGG<br>AAGGGCCTGGAGTGGATTGGGAACATCTATTACAGTGGGAGCAC<br>CTACTACAACCCGTCCCTCAAGAGTCGAGTTACCATATCAGTAG<br>ACACGTCTAAGAACCAGTTCTCCCTGAAGCTGAGTTCTGTGACC<br>GCCGCAGACACGGCGGTGTACTACTGCGCCAGAGATGGTGTGTA<br>CCAACCTGGTGCCTACTATTGGGGACAGGGTACATTGGTCACCG<br>TCTCCTCA |
| 714 | LCDR1 (IMGT) | QGISSW |
| 715 | LCDR2 (IMGT) | GAS |
| 716 | LCDR3 (IMGT) | QQGVSFPIT |
| 717 | LCDR1 (ADI) | RASQGISSWLA |
| 718 | LCDR2 (ADI) | GASSLQS |
| 719 | LCDR3 (ADI) | QQGVSFPIT |
| 720 | VL | DIQLTQSPSSVSASVGDRVTITCRASQGISSWLAWYQQKPGKAP<br>KLLIYGASSLQSGVPSRFSGSGSGTDFTLTISSLQPEDFATYYC<br>QQGVSFPITFGGGTKVEIK |

TABLE 12-continued

SEQUENCE LISTING

| SEQ ID NO | Description | Sequence |
|---|---|---|
| 721 | DNA VL | GACATCCAGTTGACCCAGTCTCCATCTTCCGTGTCTGCATCTGT<br>AGGAGACAGAGTCACCATCACTTGTCGGGCGAGTCAGGGTATTA<br>GCAGCTGGTTAGCCTGGTATCAGCAGAAACCAGGGAAAGCCCCT<br>AAGCTCCTGATCTATGGTGCATCCAGTTTGCAAAGTGGGGTCCC<br>ATCAAGGTTCAGCGGCAGTGGATCTGGGACAGATTTCACTCTCA<br>CCATCAGCAGCCTGCAGCCTGAAGATTTTGCAACTTATTACTGT<br>CAGCAGGGAGTCAGTTTCCCTATCACTTTTGGCGGAGGGACCAA<br>GGTTGAGATCAAA |
| 722 | Heavy Chain | QVQLQESGPGLVKPSQTLSLTCTVSGGSISSGGYYWSWIRQHPG<br>KGLEWIGNIYYSGSTYYNPSLKSRVTISVDTSKNQFSLKLSSVT<br>AADTAVYYCARDGVYQPGAYYWGQGTLVTVSSASTKGPSVFPLA<br>PSSKSTSGGTAALGCLVKDYFPEPVTVSWNSGALTSGVHTFPAV<br>LQSSGLYSLSSVVTVPSSSLGTQTYICNVNHKPSNTKVDKKVEP<br>KSCDKTHTCPPCPAPELLGGPSVFLFPPKPKDTLMISRTPEVTC<br>VVVDVSHEDPEVKFNWYVDGVEVHNAKTKPREEQYNSTYRVVSV<br>LTVLHQDWLNGKEYKCKVSNKALPAPIEKTISKAKGQPREPQVY<br>TLPPSRDELTKNQVSLTCLVKGFYPSDIAVEWESNGQPENNYKT<br>TPPVLDSDGSFFLYSKLTVDKSRWQQGNVFSCSVMHEALHNHYT<br>QKSLSLSPGK |
| 723 | DNA Heavy Chain | CAGGTGCAGCTGCAGGAGTCGGGCCCAGGACTGGTGAAGCCTTC<br>ACAGACCCTGTCCCTCACCTGTACTGTCTCTGGTGGCTCCATCA<br>GCAGTGGTGGTTACTACTGGAGCTGGATCCGCCAGCACCCAGGG<br>AAGGGCCTGGAGTGGATTGGGAACATCTATTACAGTGGGAGCAC<br>CTACTACAACCCGTCCCTCAAGAGTCGAGTTACCATATCAGTAG<br>ACACGTCTAAGAACCAGTTCTCCCTGAAGCTGAGTTCTGTGACC<br>GCCGCAGACACGGCGGTGTACTACTGCGCCAGAGATGGTGTGTA<br>CCAACCTGGTGCCTACTATTGGGGACAGGGTACATTGGTCACCG<br>TCTCCTCAGCGAGCACCAAAGGCCCGAGCGTGTTTCCGCTGGCG<br>CCGAGCAGCAAAAGCACCAGCGGCGGCACCGCGGCGCTGGGCTG<br>CCTGGTGAAAGATTATTTTCCGGAACCGGTGACCGTGAGCTGGA<br>ACAGCGGCGCGCTGACCAGCGGCGTGCATACCTTTCCGGCGGTG<br>CTGCAGAGCAGCGGCCTGTATAGCCTGAGCAGCGTGGTGACCGT<br>GCCGAGCAGCAGCCTGGGCACCCAGACCTATATTTGCAACGTGA<br>ACCATAAACCGAGCAACACCAAAGTGGATAAAAAAGTGGAACCG<br>AAAAGCTGCGATAAAACCCATACCTGCCCGCCGTGCCCGGCGCC<br>GGAACTGCTGGGCGGCCCCGAGCGTGTTTCTGTTTCCGCCGAAAC<br>CGAAAGATACCCTGATGATTAGCCGCACCCCGGAAGTGACCTGC<br>GTGGTGGTGGATGTGAGCCATGAAGATCCGGAAGTGAAATTTAA<br>CTGGTATGTGGATGGCGTGGAAGTGCATAACGCGAAAACCAAAC<br>CGCGCGAAGAACAGTATAACAGCACCTATCGCGTGGTGAGCGTG<br>CTGACCGTGCTGCATCAGGATTGGCTGAACGGCAAAGAATATAA<br>ATGCAAAGTGAGCAACAAAGCGCTGCCGGCGCCGATTGAAAAAA<br>CCATTAGCAAAGCGAAAGGCCAGCCGCGCGAACCGCAGGTGTAT<br>ACCCTGCCGCCGAGCCGCGATGAACTGACCAAAAACCAGGTGAG<br>CCTGACCTGCCTGGTGAAAGGCTTTTATCCGAGCGATATTGCGG<br>TGGAATGGGAAAGCAACGGCCAGCCGGAAAACAACTATAAAACC<br>ACCCCGCCGGTGCTGGATAGCGATGGCAGCTTTTTTCTGTATAG<br>CAAACTGACCGTGGATAAAAGCCGCTGGCAGCAGGGCAACGTGT<br>TTAGCTGCAGCGTGATGCATGAAGCGCTGCATAACCATTATACC<br>CAGAAAAGCCTGAGCCTGAGCCCGGGCAAA |
| 724 | Light Chain | DIQLTQSPSSVSASVGDRVTITCRASQGISSWLAWYQQKPGKAP<br>KLLIYGASSLQSGVPSRFSGSGSGTDFTLTISSLQPEDFATYYC<br>QQGVSFPITFGGGTKVEIKRTVAAPSVFIFPPSDEQLKSGTASV<br>VCLLNNFYPREAKVQWKVDNALQSGNSQESVTEQDSKDSTYSLS<br>STLTLSKADYEKHKVYACEVTHQGLSSPVTKSFNRGEC |
| 725 | DNA Light Chain | GACATCCAGTTGACCCAGTCTCCATCTTCCGTGTCTGCATCTGT<br>AGGAGACAGAGTCACCATCACTTGTCGGGCGAGTCAGGGTATTA<br>GCAGCTGGTTAGCCTGGTATCAGCAGAAACCAGGGAAAGCCCCT<br>AAGCTCCTGATCTATGGTGCATCCAGTTTGCAAAGTGGGGTCCC<br>ATCAAGGTTCAGCGGCAGTGGATCTGGGACAGATTTCACTCTCA<br>CCATCAGCAGCCTGCAGCCTGAAGATTTTGCAACTTATTACTGT<br>CAGCAGGGAGTCAGTTTCCCTATCACTTTTGGCGGAGGGACCAA<br>GGTTGAGATCAAACGTACGGTGGCCGCTCCCTCCGTGTTCATCT<br>TCCCACCCTCCGACGAGCAGCTGAAGTCCGGCACCGCCTCCGTC<br>GTGTGCCTGCTGAACAACTTCTACCCTCGCGAGGCCAAAGTGCA<br>GTGGAAAGTGGACAACGCCCTGCAGTCCGGCAACTCCCAGGAAT<br>CCGTCACCGAGCAGGACTCCAAGGACAGCACCTACTCCCTGTCC<br>TCCACCCTGACCCTGTCCAAGGCCGACTACGAGAAGCACAAAGT<br>GTACGCCTGCGAAGTGACCCACCAGGGCCTGTCCAGCCCCGTGA<br>CCAAGTCCTTCAACCGGGGCGAGTGC |

TABLE 12-continued

SEQUENCE LISTING

| SEQ ID NO | Description | Sequence |
|---|---|---|

SRF605-B

| 726 | Heavy Chain | QVQLQESGPGLVKPSQTLSLTCTVSGGSISSGGYYWSWIRQHPG
KGLEWIGNIYYSGSTYYNPSLKSRVTISVDTSKNQFSLKLSSVT
AADTAVYYCARDGVYQPGAYYWGQGTLVTVSSASTKGPSVFPLA
PCSRSTSESTAALGCLVKDYFPEPVTVSWNSGALTSGVHTFPAV
LQSSGLYSLSSVVTVPSSSLGTKTYTCNVDHKPSNTKVDKRVES
KYGPPCPSCPAPEFLGGPSVFLFPPKPKDTLMISRTPEVTCVVV
DVSQEDPEVQFNWYVDGVEVHNAKTKPREEQFNSTYRVVSVLTV
LHQDWLNGKEYKCKVSNKGLPSSIEKTISKAKGQPREPQVYTLP
PSQEEMTKNQVSLTCLVKGFYPSDIAVEWESNGQPENNYKTTPP
VLDSDGSFFLYSRLTVDKSRWQEGNVFSCSVMHEALHNHYTQKS
LSLSLG |
| 727 | DNA Heavy Chain | CAGGTGCAGCTGCAGGAGTCGGGCCCAGGACTGGTGAAGCCTTC
ACAGACCCTGTCCCTCACCTGTACTGTCTCTGGTGGCTCCATCA
GCAGTGGTGGTTACTACTGGAGCTGGATCCGCCAGCACCCAGGG
AAGGGCCTGGAGTGGATTGGGAACATCTATTACAGTGGGAGCAC
CTACTACAACCCGTCCCTCAAGAGTCGAGTTACCATATCAGTAG
ACACGTCTAAGAACCAGTTCTCCCTGAAGCTGAGTTCTGTGACC
GCCGCAGACACGGCGGTGTACTACTGCGCCAGAGATGGTGTGTA
CCAACCTGGTGCCTACTATTGGGGACAGGGTACATTGGTCACCG
TCTCCTCAGCTTCCACCAAGGGCCCCTCCGTGTTCCCTCTGGCC
CCTTGCTCCCGGTCCACCTCCGAGTCTACCGCCGCTCTGGGCTG
CCTCGTGAAGGACTACTTCCCCGAGCCCGTGACCGTGTCCTGGA
ACTCTGGCGCCCTGACCTCCGGCGTGCACACCTTCCCTGCCGTG
CTGCAGTCCTCCGGCCTGTACTCCCTGTCCAGCGTCGTGACCGT
GCCCTCCTCCAGCCTGGGCACCAAGACCTACACCTGTAACGTGG
ACCACAAGCCCTCCAACACCAAAGTGGACAAGCGGGTGGAATCT
AAGTACGGCCCTCCCTGCCCTTCCTGCCCTGCCCCTGAGTTCCT
GGGCGGACCTTCCGTGTTCCTGTTCCCTCCAAAGCCCAAGGACA
CCCTGATGATCTCCCGGACCCCTGAAGTGACCTGCGTGGTGGTG
GACGTGTCCCAGGAAGATCCCGAAGTCCAGTTCAATTGGTACGT
GGACGGCGTGGAAGTGCACAACGCCAAGACCAAGCCCAGAGAGG
AACAGTTCAACTCCACCTACCGGGTGGTGTCCGTGCTGACCGTG
CTGCACCAGGACTGGCTGAACGGCAAAGAGTACAAGTGCAAAGT
GTCCAACAAGGGCCTGCCCTCCAGCATCGAAAAGACCATCTCCA
AGGCCAAGGGCCAGCCCCGCGAGCCCCAAGTGTACACCCTGCCT
CCCAGCCAGGAAGAGATGACCAAGAATCAAGTGTCCCTGACTTG
TCTGGTCAAGGGCTTCTACCCCTCCGATATCGCCGTGGAGTGGG
AGTCCAACGGCCAGCCCGAGAACAACTACAAGACCACCCCTCCC
GTGCTGGACTCCGACGGCTCCTTCTTCCTGTACTCTCGGCTGAC
CGTGGACAAGTCCCGGTGGCAGGAAGGCAACGTCTTCTCCTGCT
CCGTGATGCACGAGGCCCTGCACAACCACTACACCCAGAAGTCC
CTGTCCCTGTCTCTGGGC |

SRF573-A

| 728 | HCDR1 (IMGT) | GGTFSSYA |
| 729 | HCDR2 (IMGT) | IIPIFGTA |
| 730 | HCDR3 (IMGT) | ARSYYSSRWHYYYYMDV |
| 731 | HCDR1 (ADI) | GTFSSYAIS |
| 732 | HCDR2 (ADI) | GIIPIFGTANYAQKFQG |
| 733 | HCDR3 (ADI) | ARSYYSSRWHYYYYMDV |
| 734 | VH | QVQLVQSGAEVKKPGSSVKVSCKASGGTFSSYAISWVRQAPGQG
LEWMGGIIPIFGTANYAQKFQGRVTITADESTSTAYMELSSLRS
EDTAVYYCARSYYSSRWHYYYYMDVWGKGTTVTVSS |
| 735 | DNA VH | CAGGTGCAGCTGGTGCAGTCTGGGGCTGAGGTGAAGAAGCCTGG
GTCCTCGGTGAAGGTCTCCTGCAAGGCTTCTGGAGGCACCTTCA
GCAGCTATGCTATCAGCTGGGTGCGACAGGCCCCTGGACAAGGG
CTTGAGTGGATGGGAGGGATCATCCCTATCTTTGGTACAGCAAA
CTACGCACAGAAGTTCCAGGGCAGAGTCACGATTACCGCGGACG
AATCCACGAGCACAGCCTACATGGAGCTGAGCAGCCTGAGATCT
GAGGACACGGCGGTGTACTACTGCGCCAGATCTTACTACTCCAG
CCGATGGCACTACTACTACTACATGGACGTGTGGGGCAAGGGTA
CAACTGTCACCGTCTCCTCA |
| 736 | LCDR1 (IMGT) | QGISSW |
| 737 | LCDR2 (IMGT) | AAS |
| 738 | LCDR3 (IMGT) | QQADDLPLT |

TABLE 12-continued

SEQUENCE LISTING

| SEQ ID NO | Description | Sequence |
|---|---|---|
| 739 | LCDR1 (ADI) | RASQGISSWLA |
| 740 | LCDR2 (ADI) | AASNLQS |
| 741 | LCDR3 (ADI) | QQADDLPLT |
| 742 | VL | DIQMTQSPSSVSASVGDRVTITCRASQGISSWLAWYQQKPGKAP KLLIYAASNLQSGVPSRFSGSGSGTDFTLTISSLQPEDFATYYC QQADDLPLTFGGGTKVEIK |
| 743 | DNA VL | GACATCCAGATGACCCAGTCTCCATCTTCCGTGTCTGCATCTGT AGGAGACAGAGTCACCATCACTTGTCGGGCGAGTCAGGGTATTA GCAGCTGGTTAGCCTGGTATCAGCAGAAACCAGGGAAAGCCCCT AAGCTCCTGATCTATGCTGCATCCAATTTGCAAAGTGGGGTCCC ATCAAGGTTCAGCGGCAGTGGATCTGGGACAGATTTCACTCTCA CCATCAGCAGCCTGCAGCCTGAAGATTTTGCAACTTATTACTGT CAGCAGGCAGACGACCTCCCTCTCACTTTTGGCGGAGGGACCAA GGTTGAGATCAAA |
| 744 | Heavy Chain | QVQLVQSGAEVKKPGSSVKVSCKASGGTFSSYAISWVRQAPGQG LEWMGGIIPIFGTANYAQKFQGRVTITADESTSTAYMELSSLRS EDTAVYYCARSYYSSRWHYYYYMDVWGKGTTVTVSSASTKGPSV FPLAPSSKSTSGGTAALGCLVKDYFPEPVTVSWNSGALTSGVHT FPAVLQSSGLYSLSSVVTVPSSSLGTQTYICNVNHKPSNTKVDK KVEPKSCDKTHTCPPCPAPELLGGPSVFLFPPKPKDTLMISRTP EVTCVVVDVSHEDPEVKFNWYVDGVEVHNAKTKPREEQYNSTYR VVSVLTVLHQDWLNGKEYKCKVSNKALPAPIEKTISKAKGQPRE PQVYTLPPSRDELTKNQVSLTCLVKGFYPSDIAVEWESNGQPEN NYKTTPPVLDSDGSFFLYSKLTVDKSRWQQGNVFSCSVMHEALH NHYTQKSLSLSPGK |
| 745 | DNA Heavy Chain | CAGGTGCAGCTGGTGCAGTCTGGGGCTGAGGTGAAGAAGCCTGG GTCCTCGGTGAAGGTCTCCTGCAAGGCTTCTGGAGGCACCTTCA GCAGCTATGCTATCAGCTGGGTGCGACAGGCCCCTGGACAAGGG CTTGAGTGGATGGGAGGGATCATCCCTATCTTTGGTACAGCAAA CTACGCACAGAAGTTCCAGGGCAGAGTCACGATTACCGCGGACG AATCCACGAGCACAGCCTACATGGAGCTGAGCAGCCTGAGATCT GAGGACACGGCGGTGTACTACTGCGCCAGATCTTACTACTCCAG CCGATGGCACTACTACTACATGGACGTGTGGGGCAAGGGTA CAACTGTCACCGTCTCCTCAGCGAGCACCAAAGGCCCCGAGCGTG TTTCCGCTGGCGCCGAGCAGCAAAAGCACCAGCGGCGGCACCGC GGCGCTGGGCTGCCTGGTGAAAGATTATTTTCCGGAACCGGTGA CCGTGAGCTGGAACAGCGGCGCGCTGACCAGCGGCGTGCATACC TTTCCGGCGGTGCTGCAGAGCAGCGGCCTGTATAGCCTGAGCAG CGTGGTGACCGTGCCGAGCAGCAGCCTGGGCACCCAGACCTATA TTTGCAACGTGAACCATAAACCGAGCAACACCAAAGTGGATAAA AAAGTGGAACCGAAAAGCTGCGATAAAACCCATACCTGCCCGCC GTGCCCGGCGCCGGAACTGCTGGGCGGCCCGAGCGTGTTTCTGT TTCCGCCGAAACCGAAAGATACCCTGATGATTAGCCGCACCCCG GAAGTGACCTGCGTGGTGGTGGATGTGAGCCATGAAGATCCGGA AGTGAAATTTAACTGGTATGTGGATGGCGTGGAAGTGCATAACG CGAAAACCAAACCGCGCGAAGAACAGTATAACAGCACCTATCGC GTGGTGAGCGTGCTGACCGTGCTGCATCAGGATTGGCTGAACGG CAAAGAATATAAATGCAAAGTGAGCAACAAAGCGCTGCCGGCGC CGATTGAAAAAACCATTAGCAAAGCGAAAGGCCAGCCGCGCGAA CCGCAGGTGTATACCCTGCCGCCGAGCCGCGATGAACTGACCAA AAACCAGGTGAGCCTGACCTGCCTGGTGAAAGGCTTTTATCCGA GCGATATTGCGGTGGAATGGGAAAGCAACGGCCAGCCGGAAAAC AACTATAAAACCACCCCGCCGGTGCTGGATAGCGATGGCAGCTT TTTTCTGTATAGCAAACTGACCGTGGATAAAAGCCGCTGGCAGC AGGGCAACGTGTTTAGCTGCAGCGTGATGCATGAAGCGCTGCAT AACCATTATACCCAGAAAAGCCTGAGCCTGAGCCCGGGCAAA |
| 746 | Light Chain | DIQMTQSPSSVSASVGDRVTITCRASQGISSWLAWYQQKPGKAP KLLIYAASNLQSGVPSRFSGSGSGTDFTLTISSLQPEDFATYYC QQADDLPLTFGGGTKVEIKRTVAAPSVFIFPPSDEQLKSGTASV VCLLNNFYPREAKVQWKVDNALQSGNSQESVTEQDSKDSTYSLS STLTLSKADYEKHKVYACEVTHQGLSSPVTKSFNRGEC |
| 747 | DNA Light Chain | GACATCCAGATGACCCAGTCTCCATCTTCCGTGTCTGCATCTGT AGGAGACAGAGTCACCATCACTTGTCGGGCGAGTCAGGGTATTA GCAGCTGGTTAGCCTGGTATCAGCAGAAACCAGGGAAAGCCCCT AAGCTCCTGATCTATGCTGCATCCAATTTGCAAAGTGGGGTCCC ATCAAGGTTCAGCGGCAGTGGATCTGGGACAGATTTCACTCTCA CCATCAGCAGCCTGCAGCCTGAAGATTTTGCAACTTATTACTGT CAGCAGGCAGACGACCTCCCTCTCACTTTTGGCGGAGGGACCAA GGTTGAGATCAAACGTACGGTGGCCGCTCCCTCCGTGTTCATCT TCCCACCCTCCGACGAGCAGCTGAAGTCCGGCACCGCCTCCGTC GTGTGCCTGCTGAACAACTTCTACCCTCGCGAGGCCAAAGTGCA GTGGAAAGTGGACAACGCCCTGCAGTCCGGCAACTCCCAGGAAT CCGTCACCGAGCAGGACTCCAAGGACAGCACCTACTCCCTGTCC |

TABLE 12-continued

SEQUENCE LISTING

| SEQ ID NO | Description | Sequence |
|---|---|---|
| | | TCCACCCTGACCCTGTCCAAGGCCGACTACGAGAAGCACAAAGT<br>GTACGCCTGCGAAGTGACCCACCAGGGCCTGTCCAGCCCCGTGA<br>CCAAGTCCTTCAACCGGGGCGAGTGC |

SRF573-B

| SEQ ID NO | Description | Sequence |
|---|---|---|
| 748 | Heavy Chain | QVQLVQSGAEVKKPGSSVKVSCKASGGTFSSYAISWVRQAPGQG<br>LEWMGGIIPIFGTANYAQKFQGRVTITADESTSTAYMELSSLRS<br>EDTAVYYCARSYYSSRWHYYYMDVWGKGTTVTVSSASTKGPSV<br>FPLAPCSRSTSESTAALGCLVKDYFPEPVTVSWNSGALTSGVHT<br>FPAVLQSSGLYSLSSVVTVPSSSLGTKTYTCNVDHKPSNTKVDK<br>RVESKYGPPCPSCPAPEFLGGPSVFLFPPKPKDTLMISRTPEVT<br>CVVVDVSQEDPEVQFNWYVDGVEVHNAKTKPREEQFNSTYRVVS<br>VLTVLHQDWLNGKEYKCKVSNKGLPSSIEKTISKAKGQPREPQV<br>YTLPPSQEEMTKNQVSLTCLVKGFYPSDIAVEWESNGQPENNYK<br>TTPPVLDSDGSFFLYSRLTVDKSRWQEGNVFSCSVMHEALHNHY<br>TQKSLSLSLG |
| 749 | DNA Heavy Chain | CAGGTGCAGCTGGTGCAGTCTGGGGCTGAGGTGAAGAAGCCTGG<br>GTCCTCGGTGAAGGTCTCCTGCAAGGCTTCTGGAGGCACCTTCA<br>GCAGCTATGCTATCAGCTGGGTGCGACAGGCCCCTGGACAAGGG<br>CTTGAGTGGATGGGAGGGATCATCCCTATCTTTGGTACAGCAAA<br>CTACGCACAGAAGTTCCAGGGCAGAGTCACGATTACCGCGGACG<br>AATCCACGAGCACAGCCTACATGGAGCTGAGCAGCCTGAGATCT<br>GAGGACACGGCGGTGTACTACTGCGCCAGATCTTACTACTCCAG<br>CCGATGGCACTACTACTACTACATGGACGTGTGGGGCAAGGGTA<br>CAACTGTCACCGTCTCCTCAGCTTCCACCAAGGGCCCCTCCGTG<br>TTCCCTCTGGCCCCTTGCTCCCGGTCCACCTCCGAGTCTACCGC<br>CGCTCTGGGCTGCCTCGTGAAGGACTACTTCCCCGAGCCCGTGA<br>CCGTGTCCTGGAACTCTGGCGCCCTGACCTCCGGCGTGCACACC<br>TTCCCTGCCGTGCTGCAGTCCTCCGGCCTGTACTCCCTGTCCAG<br>CGTCGTGACCGTGCCCTCCTCCAGCCTGGGCACCAAGACCTACA<br>CCTGTAACGTGGACCACAAGCCCTCCAACACCAAAGTGGACAAG<br>CGGGTGGAATCTAAGTACGGCCCTCCCTGCCCTTCCTGCCCTGC<br>CCCTGAGTTCCTGGGCGGACCTTCCGTGTTCCTGTTCCCTCCAA<br>AGCCCAAGGACACCCTGATGATCTCCCGGACCCCTGAAGTGACC<br>TGCGTGGTGGTGGACGTGTCCAGGAAGATCCCGAAGTCCAGTT<br>CAATTGGTACGTGGACGGCGTGGAAGTGCACAACGCCAAGACCA<br>AGCCCAGAGAGGAACAGTTCAACTCCACCTACCGGGTGGTGTCC<br>GTGCTGACCGTGCTGCACCAGGACTGGCTGAACGGCAAAGAGTA<br>CAAGTGCAAAGTGTCCAACAAGGGCCTGCCCTCCAGCATCGAAA<br>AGACCATCTCCAAGGCCAAGGGCCAGCCCCGCGAGCCCCAAGTG<br>TACACCCTGCCTCCCAGCCAGGAAGAGATGACCAAGAATCAAGT<br>GTCCCTGACTTGTCTGGTCAAGGGCTTCTACCCCTCCGATATCG<br>CCGTGGAGTGGGAGTCCAACGGCCAGCCCGAGAACAACTACAAG<br>ACCACCCCTCCCGTGCTGGACTCCGACGGCTCCTTCTTCCTGTA<br>CTCTCGGCTGACCGTGGACAAGTCCCGGTGGCAGGAAGGCAACG<br>TCTTCCTGCTCCGTGATGCACGAGGCCCTGCACAACCACTAC<br>ACCCAGAAGTCCCTGTCCCTGTCTCTGGGC |

SRF541-A

| SEQ ID NO | Description | Sequence |
|---|---|---|
| 750 | HCDR1 (IMGT) | GGSISSYY |
| 751 | HCDR2 (IMGT) | IYYSGST |
| 752 | HCDR3 (IMGT) | AREVDRDDVAFDI |
| 753 | HCDR1 (ADI) | GSISSYYWS |
| 754 | HCDR2 (ADI) | SIYYSGSTNYNPSLKS |
| 755 | HCDR3 (ADI) | AREVDRDDVAFDI |
| 756 | VH | QVQLQESGPGLVKPSETLSLTCTVSGGSISSYYWSWIRQPPGKG<br>LEWIGSIYYSGSTNYNPSLKSRVTISVDTSKNQFSLKLSSVTAA<br>DTAVYYCAREVDRDDVAFDIWGQGTMVTVSS |
| 757 | DNA VH | CAGGTGCAGCTGCAGGAGTCGGGCCCAGGACTGGTGAAGCCTTC<br>GGAGACCCTGTCCCTCACCTGCACTGTCTCTGGTGGCTCCATCA<br>GTAGTTACTACTGGAGCTGGATCCGGCAGCCCCCAGGGAAGGGA<br>CTGGAGTGGATTGGGTCAATCTATTACAGTGGGAGCACCAACTA<br>CAACCCCTCCCTCAAGAGTCGAGTCACCATATCAGTAGACACGT<br>CCAAGAACCAGTTCTCCCTGAAGCTGAGTTCTGTGACCGCCGCA<br>GACACGGCGGTGTACTACTGCGCCAGAGAGGTGGACAGAGATGA<br>TGTAGCATTCGACATATGGGGTCAGGGTACAATGGTCACCGTCT<br>CCTCA |
| 758 | LCDR1 (IMGT) | QDISNY |

TABLE 12-continued

SEQUENCE LISTING

| SEQ ID NO | Description | Sequence |
|---|---|---|
| 759 | LCDR2 (IMGT) | DAS |
| 760 | LCDR3 (IMGT) | QQYVLFPIT |
| 761 | LCDR1 (ADI) | QASQDISNYLN |
| 762 | LCDR2 (ADI) | DASNLET |
| 763 | LCDR3 (ADI) | QQYVLFPIT |
| 764 | VL | DIQMTQSPSSLSASVGDRVTITCQASQDISNYLNWYQQKPGKAP KLLIYDASNLETGVPSRFSGSGSGTDFTFTISSLQPEDIATYYC QQYVLFPITFGGGTKVEIK |
| 765 | DNA VL | GACATCCAGATGACCCAGTCTCCATCCTCCCTGTCTGCATCTGT AGGAGACAGAGTCACCATCACTTGCCAGGCGAGTCAGGACATTA GCAACTATTTAAATTGGTATCAGCAGAAACCAGGGAAAGCCCCT AAGCTCCTGATCTACGATGCATCCAATTTGGAAACAGGGGTCCC ATCAAGGTTCAGTGGAAGTGGATCTGGGACAGATTTTACTTTCA CCATCAGCAGCCTGCAGCCTGAAGATATTGCAACATATTACTGT CAGCAGTACGTCCTCTTCCCTATCACTTTTGGCGGAGGGACCAA GGTTGAGATCAAA |
| 766 | Heavy Chain | QVQLQESGPGLVKPSETLSLTCTVSGGSISSYYWSWIRQPPGKG LEWIGSIYYSGSTNYNPSLKSRVTISVDTSKNQFSLKLSSVTAA DTAVYYCAREVDRDDVAFDIWGQGTMVTVSSASTKGPSVFPLAP SSKSTSGGTAALGCLVKDYFPEPVTVSWNSGALTSGVHTFPAVL QSSGLYSLSSVVTVPSSSLGTQTYICNVNHKPSNTKVDKKVEPK SCDKTHTCPPCPAPELLGGPSVFLFPPKPKDTLMISRTPEVTCV VVDVSHEDPEVKFNWYVDGVEVHNAKTKPREEQYNSTYRVVSVL TVLHQDWLNGKEYKCKVSNKALPAPIEKTISKAKGQPREPQVYT LPPSRDELTKNQVSLTCLVKGFYPSDIAVEWESNGQPENNYKTT PPVLDSDGSFFLYSKLTVDKSRWQQGNVFSCSVMHEALHNHYTQ KSLSLSPGK |
| 767 | DNA Heavy Chain | CAGGTGCAGCTGCAGGAGTCGGGCCCAGGACTGGTGAAGCCTTC GGAGACCCTGTCCCTCACCTGCACTGTCTCTGGTGGCTCCATCA GTAGTTACTACTGGAGCTGGATCCGGCAGCCCCCAGGGAAGGGA CTGGAGTGGATTGGGTCAATCTATTACAGTGGGAGCACCAACTA CAACCCCTCCCTCAAGAGTCGAGTCACCATATCAGTAGACACGT CCAAGAACCAGTTCTCCCTGAAGCTGAGTTCTGTGACCGCCGCA GACACGGCGGTGTACTACTGCGCCAGAGAGGTGGACAGAGATGA TGTAGCATTCGACATATGGGGTCAGGGTACAATGGTCACCGTCT CCTCAGCGAGCACCAAAGGCCCGAGCGTGTTTCCGCTGGCGCCG AGCAGCAAAAGCACCAGCGGCGGCACCGCGGCGCTGGGCTGCCT GGTGAAAGATTATTTTCCGGAACCGGTGACCGTGAGCTGGAACA GCGGCGCGCTGACCAGCGGCGTGCATACCTTTCCGGCGGTGCTG CAGAGCAGCGGCCTGTATAGCCTGAGCAGCGTGGTGACCGTGCC GAGCAGCAGCCTGGGCACCCAGACCTATATTTGCAACGTGAACC ATAAACCGAGCAACACCAAAGTGGATAAAAAAGTGGAACCGAAA AGCTGCGATAAAACCCATACCTGCCCGCCGTGCCCGGCGCCGGA ACTGCTGGGCGGCCCGAGCGTGTTTCTGTTTCCGCCGAAACCGA AAGATACCCTGATGATTAGCCGCACCCCGGAAGTGACCTGCGTG GTGGTGGATGTGAGCCATGAAGATCCGGAAGTGAAATTTAACTG GTATGTGGATGGCGTGGAAGTGCATAACGCGAAAACCAAACCGC GCGAAGAACAGTATAACAGCACCTATCGCGTGGTGAGCGTGCTG ACCGTGCTGCATCAGGATTGGCTGAACGGCAAAGAATATAAATG CAAAGTGAGCAACAAAGCGCTGCCGGCGCCGATTGAAAAAACCA TTAGCAAAGCGAAAGGCCAGCCGCGCGAACCGCAGGTGTATACC CTGCCGCCGAGCCGCGATGAACTGACCAAAAACCAGGTGAGCCT GACCTGCCTGGTGAAAGGCTTTTATCCGAGCGATATTGCGGTGG AATGGGAAAGCAACGGCCAGCCGGAAAACAACTATAAAACCACC CCGCCGGTGCTGGATAGCGATGGCAGCTTTTTTCTGTATAGCAA ACTGACCGTGGATAAAAGCCGCTGGCAGCAGGGCAACGTGTTTA GCTGCAGCGTGATGCATGAAGCGCTGCATAACCATTATACCCAG AAAAGCCTGAGCCTGAGCCCGGGCAAA |
| 768 | Light Chain | DIQMTQSPSSLSASVGDRVTITCQASQDISNYLNWYQQKPGKAP KLLIYDASNLETGVPSRFSGSGSGTDFTFTISSLQPEDIATYYC QQYVLFPITFGGGTKVEIKRTVAAPSVFIFPPSDEQLKSGTASV VCLLNNFYPREAKVQWKVDNALQSGNSQESVTEQDSKDSTYSLS STLTLSKADYEKHKVYACEVTHQGLSSPVTKSFNRGEC |
| 769 | DNA Light Chain | GACATCCAGATGACCCAGTCTCCATCCTCCCTGTCTGCATCTGT AGGAGACAGAGTCACCATCACTTGCCAGGCGAGTCAGGACATTA GCAACTATTTAAATTGGTATCAGCAGAAACCAGGGAAAGCCCCT AAGCTCCTGATCTACGATGCATCCAATTTGGAAACAGGGGTCCC ATCAAGGTTCAGTGGAAGTGGATCTGGGACAGATTTTACTTTCA CCATCAGCAGCCTGCAGCCTGAAGATATTGCAACATATTACTGT CAGCAGTACGTCCTCTTCCCTATCACTTTTGGCGGAGGGACCAA GGTTGAGATCAAACGTACGGTGGCCGCTCCCTCCGTGTTCATCT TCCCACCCTCCGACGAGCAGCTGAAGTCCGGCACCGCCTCCGTC GTGTGCCTGCTGAACAACTTCTACCCTCGCGAGGCCAAAGTGCA |

TABLE 12-continued

SEQUENCE LISTING

| SEQ ID NO | Description | Sequence |
|---|---|---|
| | | GTGGAAAGTGGACAACGCCCTGCAGTCCGGCAACTCCCAGGAAT<br>CCGTCACCGAGCAGGACTCCAAGGACAGCACCTACTCCCTGTCC<br>TCCACCCTGACCCTGTCCAAGGCCGACTACGAGAAGCACAAAGT<br>GTACGCCTGCGAAGTGACCCACCAGGGCCTGTCCAGCCCCGTGA<br>CCAAGTCCTTCAACCGGGGCGAGTGC |

SRF541-B

| 770 | Heavy Chain | QVQLQESGPGLVKPSETLSLTCTVSGGSISSYYWSWIRQPPGKG<br>LEWIGSIYYSGSTNYNPSLKSRVTISVDTSKNQFSLKLSSVTAA<br>DTAVYYCAREVDRDDVAFDIWGQGTMVTVSSASTKGPSVFPLAP<br>CSRSTSESTAALGCLVKDYFPEPVTVSWNSGALTSGVHTFPAVL<br>QSSGLYSLSSVVTVPSSSLGTKTYTCNVDHKPSNTKVDKRVESK<br>YGPPCPSCPAPEFLGGPSVFLFPPKPKDTLMISRTPEVTCVVVD<br>VSQEDPEVQFNWYVDGVEVHNAKTKPREEQFNSTYRVVSVLTVL<br>HQDWLNGKEYKCKVSNKGLPSSIEKTISKAKGQPREPQVYTLPP<br>SQEEMTKNQVSLTCLVKGFYPSDIAVEWESNGQPENNYKTTPPV<br>LDSDGSFFLYSRLTVDKSRWQEGNVFSCSVMHEALHNHYTQKSL<br>SLSLG |
| 771 | DNA Heavy Chain | CAGGTGCAGCTGCAGGAGTCGGGCCCAGGACTGGTGAAGCCTTC<br>GGAGACCCTGTCCCTCACCTGCACTGTCTCTGGTGGCTCCATCA<br>GTAGTTACTACTGGAGCTGGATCCGGCAGCCCCAGGGAAGGGA<br>CTGGAGTGGATTGGGTCAATCTATTACAGTGGGAGCACCAACTA<br>CAACCCCTCCCTCAAGAGTCGAGTCACCATATCAGTAGACACGT<br>CCAAGAACCAGTTCTCCCTGAAGCTGAGTTCTGTGACCGCCGCA<br>GACACGGCGGTGTACTACTGCGCCAGAGAGGTGGACAGAGATGA<br>TGTAGCATTCGACATATGGGGTCAGGGTACAATGGTCACCGTCT<br>CCTCAGCTTCCACCAAGGGCCCCTCCGTGTTCCCTCTGGCCCCT<br>TGCTCCCGGTCCACCTCCGAGTCTACCGCCGCTCTGGGCTGCCT<br>CGTGAAGGACTACTTCCCCGAGCCCGTGACCGTGTCCTGGAACT<br>CTGGCGCCCTGACCTCCGGCGTGCACACCTTCCCTGCCGTGCTG<br>CAGTCCTCCGGCCTGTACTCCCTGTCCAGCGTCGTGACCGTGCC<br>CTCCTCCAGCCTGGGCACCAAGACCTACACCTGTAACGTGGACC<br>ACAAGCCCTCCAACACCAAAGTGGACAAGCGGGTGGAATCTAAG<br>TACGGCCCTCCCTGCCCTTCCTGCCCTGCCCCTGAGTTCCTGGG<br>CGGACCTTCCGTGTTCCTGTTCCCTCCAAAGCCCAAGGACACCC<br>TGATGATCTCCCGGACCCCTGAAGTGACCTGCGTGGTGGTGGAC<br>GTGTCCCAGGAAGATCCCGAAGTCCAGTTCAATTGGTACGTGGA<br>CGGCGTGGAAGTGCACAACGCCAAGACCAAGCCCAGAGAGGAAC<br>AGTTCAACTCCACCTACCGGGTGGTGTCCGTGCTGACCGTGCTG<br>CACCAGGACTGGCTGAACGGCAAAGAGTACAAGTGCAAAGTGTC<br>CAACAAGGGCCTGCCCTCCAGCATCGAAAAGACCATCTCCAAGG<br>CCAAGGGCCAGCCCCGCGAGCCCCAAGTGTACACCCTGCCTCCC<br>AGCCAGGAAGAGATGACCAAGAATCAAGTGTCCCTGACTTGTCT<br>GGTCAAGGGCTTCTACCCCTCCGATATCGCCGTGGAGTGGGAGT<br>CCAACGGCCAGCCCGAGAACAACTACAAGACCACCCCTCCCGTG<br>CTGGACTCCGACGGCTCCTTCTTCCTGTACTCTCGGCTGACCGT<br>GGACAAGTCCCGGTGGCAGGAAGGCAACGTCTTCTCCTGCTCCG<br>TGATGCACGAGGCCCTGCACAACCACTACACCCAGAAGTCCCTG<br>TCCCTGTCTCTGGGC |

SRF583-A

| 772 | HCDR1 (IMGT) | GGSISSSSYY |
| 773 | HCDR2 (IMGT) | ISYSGST |
| 774 | HCDR3 (IMGT) | AREEYSFSYLDY |
| 775 | HCDR1 (ADI) | GSISSSSYYWG |
| 776 | HCDR2 (ADI) | SISYSGSTYYNPSLKS |
| 777 | HCDR3 (ADI) | AREEYSFSYLDY |
| 778 | VH | QLQLQESGPGLVKPSETLSLTCTVSGGSISSSSYYWGWIRQPPG<br>KGLEWIGSISYSGSTYYNPSLKSRVTISVDTSKNQFSLKLSSVT<br>AADTAVYYCAREEYSFSYLDYWGQGTTVTVSS |
| 779 | DNA VH | CAGCTGCAGCTGCAGGAGTCGGGCCCAGGACTGGTGAAGCCTTC<br>GGAGACCCTGTCCCTCACCTGCACTGTCTCTGGTGGCTCCATCA<br>GCAGTAGTAGTTACTACTGGGGCTGGATCCGCCAGCCCCCAGGG<br>AAGGGGCTGGAGTGGATTGGGAGTATCTCCTATAGTGGGAGCAC<br>CTACTACAACCCGTCCCTCAAGAGTCGAGTCACCATATCCGTAG<br>ACACGTCCAAGAACCAGTTCTCCCTGAAGCTGAGTTCTGTGACC<br>GCCGCAGACACGGCGGTGTACTACTGCGCCAGAGAGGAATATAG<br>CTTCAGCTACTTAGATTACTGGGGACAGGGAACAACTGTCACCG<br>TCTCCTCA |

TABLE 12-continued

SEQUENCE LISTING

| SEQ ID NO | Description | Sequence |
|---|---|---|
| 780 | LCDR1 (IMGT) | QGISSW |
| 781 | LCDR2 (IMGT) | AAS |
| 782 | LCDR3 (IMGT) | QQALLFPPT |
| 783 | LCDR1 (ADI) | RASQGISSWLA |
| 784 | LCDR2 (ADI) | AASNLQS |
| 785 | LCDR3 (ADI) | QQALLFPPT |
| 786 | VL | DIQMTQSPSSVSASVGDRVTITCRASQGISSWLAWYQQKPGKAP KLLIYAASNLQSGVPSRFSGSGSGTDFTLTISSLQPEDFATYYC QQALLFPPTFGGGTKVEIK |
| 787 | DNA VL | GACATCCAGATGACCCAGTCTCCATCTTCCGTGTCTGCATCTGT AGGAGACAGAGTCACCATCACTTGTCGGGCGAGTCAGGGTATTA GCAGCTGGTTAGCCTGGTATCAGCAGAAACCAGGGAAAGCCCCT AAGCTCCTGATCTATGCTGCATCCAATTTGCAAAGTGGGGTCCC ATCAAGGTTCAGCGGCAGTGGATCTGGGACAGATTTCACTCTCA CCATCAGCAGCCTGCAGCCTGAAGATTTTGCAACTTATTACTGT CAGCAGGCACTCCTCTTCCCTCCTACTTTTGGCGGAGGGACCAA GGTTGAGATCAAA |
| 788 | Heavy Chain | QLQLQESGPGLVKPSETLSLTCTVSGGSISSSSYYWGWIRQPPG KGLEWIGSISYSGSTYYNPSLKSRVTISVDTSKNQFSLKLSSVT AADTAVYYCAREEYSFSYLDYWGQGTTVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKKVEP KSCDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVY TLPPSRDELTKNQVSLTCLVKGFYPSDIAVEWESNGQPENNYKT TPPVLDSDGSFFLYSKLTVDKSRWQQGNVFSCSVMHEALHNHYT QKSLSLSPGK |
| 789 | DNA Heavy Chain | CAGCTGCAGCTGCAGGAGTCGGGCCCAGGACTGGTGAAGCCTTC GGGAGACCCTGTCCCTCACCTGCACTGTCTCTGGTGGCTCCATCA GCAGTAGTAGTTACTACTGGGGCTGGATCCGCCAGCCCCCAGGG AAGGGGCTGGAGTGGATTGGGAGTATCTCCTATAGTGGGAGCAC CTACTACAACCCGTCCCTCAAGAGTCGAGTCACCATATCCGTAG ACACGTCCAAGAACCAGTTCTCCCTGAAGCTGAGTTCTGTGACC GCCGCAGACACGGCGGTGTACTACTGCGCCAGAGAGGAATATAG CTTCAGCTACTTAGATTACTGGGGACAGGGAACAACTGTCACCG TCTCCTCAGCGAGCACCAAAGGCCCGAGCGTGTTTCCGCTGGCG CCGAGCAGCAAAAGCACCAGCGGCGGCACCGCGGCGCTGGGCTG CCTGGTGAAAGATTATTTTCCGGAACCGGTGACCGTGAGCTGGA ACAGCGGCGCGCTGACCAGCGGCGTGCATACCTTTCCGGCGGTG CTGCAGAGCAGCGGCCTGTATAGCCTGAGCAGCGTGGTGACCGT GCCGAGCAGCAGCCTGGGCACCCAGACCTATATTTGCAACGTGA ACCATAAACCGAGCAACACCAAAGTGGATAAAAAAGTGGAACCG AAAAGCTGCGATAAAACCCATACCTGCCCGCCGTGCCCGGCGCC GGAACTGCTGGGCGGCCCGAGCGTGTTTCTGTTTCCGCCGAAAC CGAAAGATACCCTGATGATTAGCCGCACCCCGGAAGTGACCTGC GTGGTGGTGGATGTGAGCCATGAAGATCCGGAAGTGAAATTTAA CTGGTATGTGGATGGCGTGGAAGTGCATAACGCGAAAACCAAAC CGCGCGAAGAACAGTATAACAGCACCTATCGCGTGGTGAGCGTG CTGACCGTGCTGCATCAGGATTGGCTGAACGGCAAAGAATATAA ATGCAAAGTGAGCAACAAAGCGCTGCCGGCGCCGATTGAAAAAA CCATTAGCAAAGCGAAAGGCCAGCCGCGCGAACCGCAGGTGTAT ACCCTGCCGCCGAGCCGCGATGAACTGACCAAAAACCAGGTGAG CCTGACCTGCCTGGTGAAAGGCTTTTATCCGAGCGATATTGCGG TGGAATGGGAAAGCAACGGCCAGCCGGAAAACAACTATAAAACC ACCCCGCCGGTGCTGGATAGCGATGGCAGCTTTTTTCTGTATAG CAAACTGACCGTGGATAAAAGCCGCTGGCAGCAGGGCAACGTGT TTAGCTGCAGCGTGATGCATGAAGCGCTGCATAACCATTATACC CAGAAAAGCCTGAGCCTGAGCCCGGGCAAA |
| 790 | Light Chain | DIQMTQSPSSVSASVGDRVTITCRASQGISSWLAWYQQKPGKAP KLLIYAASNLQSGVPSRFSGSGSGTDFTLTISSLQPEDFATYYC QQALLFPPTFGGGTKVEIKRTVAAPSVFIFPPSDEQLKSGTASV VCLLNNFYPREAKVQWKVDNALQSGNSQESVTEQDSKDSTYSLS STLTLSKADYEKHKVYACEVTHQGLSSPVTKSFNRGEC |
| 791 | DNA Light Chain | GACATCCAGATGACCCAGTCTCCATCTTCCGTGTCTGCATCTGT AGGAGACAGAGTCACCATCACTTGTCGGGCGAGTCAGGGTATTA GCAGCTGGTTAGCCTGGTATCAGCAGAAACCAGGGAAAGCCCCT AAGCTCCTGATCTATGCTGCATCCAATTTGCAAAGTGGGGTCCC ATCAAGGTTCAGCGGCAGTGGATCTGGGACAGATTTCACTCTCA CCATCAGCAGCCTGCAGCCTGAAGATTTTGCAACTTATTACTGT CAGCAGGCACTCCTCTTCCCTCCTACTTTTGGCGGAGGGACCAA GGTTGAGATCAAACGTACGGTGGCCGCTCCCTCCGTGTTCATCT |

TABLE 12-continued

SEQUENCE LISTING

| SEQ ID NO | Description | Sequence |
|---|---|---|
| | | TCCCACCCTCCGACGAGCAGCTGAAGTCCGGCACCGCCTCCGTC<br>GTGTGCCTGCTGAACAACTTCTACCCTCGCGAGGCCAAAGTGCA<br>GTGGAAAGTGGACAACGCCCTGCAGTCCGGCAACTCCCAGGAAT<br>CCGTCACCGAGCAGGACTCCAAGGACAGCACCTACTCCCTGTCC<br>TCCACCCTGACCCTGTCCAAGGCCGACTACGAGAAGCACAAAGT<br>GTACGCCTGCGAAGTGACCCACCAGGGCCTGTCCAGCCCCGTGA<br>CCAAGTCCTTCAACCGGGGCGAGTGC |

SRF583-B

| 792 | Heavy Chain | QLQLQESGPGLVKPSETLSLTCTVSGGSISSSSYYWGWIRQPPG<br>KGLEWIGSISYSGSTYYNPSLKSRVTISVDTSKNQFSLKLSSVT<br>AADTAVYYCAREEYSFSYLDYWGQGTTVTVSSASTKGPSVFPLA<br>PCSRSTSESTAALGCLVKDYFPEPVTVSWNSGALTSGVHTFPAV<br>LQSSGLYSLSSVVTVPSSSLGTKTYTCNVDHKPSNTKVDKRVES<br>KYGPPCPSCPAPEFLGGPSVFLFPPKPKDTLMISRTPEVTCVVV<br>DVSQEDPEVQFNWYVDGVEVHNAKTKPREEQFNSTYRVVSVLTV<br>LHQDWLNGKEYKCKVSNKGLPSSIEKTISKAKGQPREPQVYTLP<br>PSQEEMTKNQVSLTCLVKGFYPSDIAVEWESNGQPENNYKTTPP<br>VLDSDGSFFLYSRLTVDKSRWQEGNVFSCSVMHEALHNHYTQKS<br>LSLSLG |
| 793 | DNA Heavy Chain | CAGCTGCAGCTGCAGGAGTCGGGCCCAGGACTGGTGAAGCCTTC<br>GGAGACCCTGTCCCTCACCTGCACTGTCTCTGGTGGCTCCATCA<br>GCAGTAGTAGTTACTACTGGGGCTGGATCCGCCAGCCCCCAGGG<br>AAGGGGCTGGAGTGGATTGGGAGTATCTCCTATAGTGGGAGCAC<br>CTACTACAACCCGTCCCTCAAGAGTCGAGTCACCATATCCGTAG<br>ACACGTCCAAGAACCAGTTCTCCCTGAAGCTGAGTTCTGTGACC<br>GCCGCAGACACGGCGGTGTACTACTGCGCCAGAGAGGAATATAG<br>CTTCAGCTACTTAGATTACTGGGGACAGGGAACAACTGTCACCG<br>TCTCCTCAGCTTCCACCAAGGGCCCCTCCGTGTTCCCTCTGGCC<br>CCTTGCTCCCGGTCCACCTCCGAGTCTACCGCCGCTCTGGGCTG<br>CCTCGTGAAGGACTACTTCCCCGAGCCCGTGACCGTGTCCTGGA<br>ACTCTGGCGCCCTGACCTCCGGCGTGCACACCTTCCCTGCCGTG<br>CTGCAGTCCTCCGGCCTGTACTCCCTGTCCAGCGTCGTGACCGT<br>GCCCTCCTCCAGCCTGGGCACCAAGACCTACACCTGTAACGTGG<br>ACCACAAGCCCTCCAACACCAAAGTGGACAAGCGGGTGGAATCT<br>AAGTACGGCCCTCCCTGCCCTTCCTGCCCTGCCCCTGAGTTCCT<br>GGGCGGACCTTCCGTGTTCCTGTTCCCTCCAAAGCCCAAGGACA<br>CCCTGATGATCTCCCGGACCCCTGAAGTGACCTGCGTGGTGGTG<br>GACGTGTCCCAGGAAGATCCCGAAGTCCAGTTCAATTGGTACGT<br>GGACGGCGTGGAAGTGCACAACGCCAAGACCAAGCCCAGAGAGG<br>AACAGTTCAACTCCACCTACCGGGTGGTGTCCGTGCTGACCGTG<br>CTGCACCAGGACTGGCTGAACGGCAAGGAGTACAAGTGCAAAGT<br>GTCCAACAAGGGCCTGCCCTCCAGCATCGAAAAGACCATCTCCA<br>AGGCCAAGGGCCAGCCCCGCGAGCCCCAAGTGTACACCCTGCCT<br>CCCAGCCAGGAAGAGATGACCAAGAATCAAGTGTCCCTGACTTG<br>TCTGGTCAAGGGCTTCTACCCCTCCGATATCGCCGTGGAGTGGG<br>AGTCCAACGGCCAGCCCGAGAACAACTACAAGACCACCCCTCCC<br>GTGCTGGACTCCGACGGCTCCTTCTTCCTGTACTCTCGGCTGAC<br>CGTGGACAAGTCCCGGTGGCAGGAAGGCAACGTCTTCTCCTGCT<br>CCGTGATGCACGAGGCCCTGCACAACCACTACACCCAGAAGTCC<br>CTGTCCCTGTCTCTGGGC |

8B11

| 794 | VH | QVQLQQSGPGLVKPSQTLSLTCAISGYSVSSNNAAWNWIRQSPS<br>RGLEWLGRTYYRSKWYNDYALSVKSRVTINPDTSKNQFSLHLNP<br>VTPEDTALYFCARGLPMVPFDSWGQGTLVTVSS |
| 795 | DNA VH | CAGGTACAGCTGCAGCAGTCAGGTCCAGGACTGGTGAAGCCCTC<br>GCAGACCCTCTCACTCACCTGTGCCATCTCCGGGTACAGTGTCT<br>CTAGCAACAACGCTGCTTGGAACTGGATCAGGCAGTCCCCATCG<br>AGAGGCCTTGAGTGGCTGGGAAGGACATACTACAGGTCCAAGTG<br>GTATAATGATTATGCACTATCTGTGAAAAGTCGAGTGACCATCA<br>ATCCAGATACATCCAAGAACCAGTTCTCCCTGCACCTGAACCCT<br>GTGACTCCCGAGGACACGGCTTTGTATTTCTGTGCAAGAGGACT<br>TCCTATGGTCCCTTTTGACTCCTGGGGCCAGGGAACCCTGGTCA<br>CCGTCTCCTCA |
| 796 | VL | DIQMTQSPSTLSASVGDRVTITCRASQSISSWLAWYQQKPGKAP<br>KLLIYKASSLESGVPSRFSGSGSGTEFTLTISSLQPDDFATYFC<br>QQYDSFSMYTFGQGTKLEIK |
| 797 | DNA VL | GACATCCAGATGACCCAATCTCCTTCCACCCTGTCTGCATCTGT<br>AGGAGACAGAGTCACCATCACTTGCCGGGCCAGTCAGAGTATTA<br>GTAGCTGGTTGGCCTGGTATCAGCAGAAACCAGGGAAAGCCCCT<br>AAGCTCCTGATCTATAAGGCGTCGAGTTTAGAAAGTGGGGTCCC<br>ATCAAGGTTCAGCGGCAGTGGATCTGGGACAGAATTCACTCTCA |

TABLE 12-continued

SEQUENCE LISTING

| SEQ ID NO | Description | Sequence |
|---|---|---|
| | | CCATCAGTAGCCTGCAGCCTGATGATTTTGCAACTTATTTCTGC CAACAGTATGATAGTTTTTCCATGTACACTTTTGGCCAGGGGAC CAAGCTGGAGATCAAA |
| 798 | LCConstant | RTVAAPSVFIFPPSDEQLKSGTASVVCLLNNFYPREAKVQWKVD NALQSGNSQESVTEQDSKDSTYSLSSTLTLSKADYEKHKVYACE VTHQGLSSPVTKSFNRGEC |
| 799 | HCIgG4mt | ASTKGPSVFPLAPCSRSTSESTAALGCLVKDYFPEPVTVSWNSG ALTSGVHTFPAVLQSSGLYSLSSVVTVPSSSLGTKTYTCNVDHK PSNTKVDKRVESKYGPPCPPCPAPEFLGGPSVFLFPPKPKDTLM ISRTPEVTCVVVDVSQEDPEVQFNWYVDGVEVHNAKTKPREEQF NSTYRVVSVLTVLHQDWLNGKEYKCKVSNKGLPSSIEKTISKAK GQPREPQVYTLPPSQEEMTKNQVSLTCLVKGFYPSDIAVEWESN GQPENNYKTTPPVLDSDGSFFLYSRLTVDKSRWQEGNVFSCSVM HEALHNHYTQKSLSLSLGK |
| 800 | HCIgG4mt2 | ASTKGPSVFPLAPCSRSTSESTAALGCLVKDYFPEPVTVSWNSG ALTSGVHTFPAVLQSSGLYSLSSVVTVPSSSLGTKTYTCNVDHK PSNTKVDKRVESKYGPPCPPCPAPEFEGGPSVFLFPPKPKDTLM ISRTPEVTCVVVDVSQEDPEVQFNWYVDGVEVHNAKTKPREEQF NSTYRVVSVLTVLHQDWLNGKEYKCKVSNKGLPSSIEKTISKAK GQPREPQVYTLPPSQEEMTKNQVSLTCLVKGFYPSDIAVEWESN GQPENNYKTTPPVLDSDGSFFLYSRLTVDKSRWQEGNVFSCSVM HEALHNHYTQKSLSLSLGK |
| 801 | HCIgG1 | ASTKGPSVFPLAPSSKSTSGGTAALGCLVKDYFPEPVTVSWNSG ALTSGVHTFPAVLQSSGLYSLSSVVTVPSSSLGTQTYICNVNHK PSNTKVDKKVEPKSCDKTHTCPPCPAPELLGGPSVFLFPPKPKD TLMISRTPEVTCVVVDVSHEDPEVKFNWYVDGVEVHNAKTKPRE EQYNSTYRVVSVLTVLHQDWLNGKEYKCKVSNKALPAPIEKTIS KAKGQPREPQVYTLPPSRDELTKNQVSLTCLVKGFYPSDIAVEW ESNGQPENNYKTTPPVLDSDGSFFLYSKLTVDKSRWQQGNVFSC SVMHEALHNHYTQKSLSLSPGK |
| 802 | HCDR1 | SNNAAWN |
| 803 | HCDR2 | RTYYRSKWYNDYALSVKS |
| 804 | HCDR3 | GLPMVPFDS |
| 805 | LCDR1 | RASQSISSWLA |
| 806 | LCDR2 | KASSLES |
| 807 | LCDR3 | QQYDSFSMYT |

TABLE 13

Fc Sequences (=CH2 + CH3)

| Name | Alias | Amino Acid Sequence |
|---|---|---|
| Human IgG1 | 1.0 | EPKSCDKTHTCPPCPAPELLGGPSVFLFPPKPKDTLMISRTPEVTC VVVDVSHEDPEVKFNWYVDGVEVHNAKTKPREEQYNSTYRVVSVLT VLHQDWLNGKEYKCKVSNKALPAPIEKTISKAKGQPREPQVYTLPP SRDELTKNQVSLTCLVKGFYPSDIAVEWESNGQPENNYKTTPPVLD SDGSFFLYSKLTVDKSRWQQGNVFSCSVMHEALHNHYTQKSLSLSP GK (SEQ ID NO: 702) |
| Human IgG4 | 4.0 | ESKYGPPCPSCPAPEFLGGPSVFLFPPKPKDTLMISRTPEVTCVVV DVSQEDPEVQFNWYVDGVEVHNAKTKPREEQFNSTYRVVSVLTVLH QDWLNGKEYKCKVSNKGLPSSIEKTISKAKGQPREPQVYTLPPSQE EMTKNQVSLTCLVKGFYPSDIAVEWESNGQPENNYKTTPPVLDSDG SFFLYSRLTVDKSRWQEGNVFSCSVMHEALHNHYTQKSLSLSLGK (SEQ ID NO: 703) |
| Human IgG4 (S228P) | 4.1 | ESKYGPPCPPCPAPEFLGGPSVFLFPPKPKDTLMISRTPEVTCVVV DVSQEDPEVQFNWYVDGVEVHNAKTKPREEQFNSTYRVVSVLTVLH QDWLNGKEYKCKVSNKGLPSSIEKTISKAKGQPREPQVYTLPPSQE EMTKNQVSLTCLVKGFYPSDIAVEWESNGQPENNYKTTPPVLDSDG SFFLYSRLTVDKSRWQEGNVFSCSVMHEALHNHYTQKSLSLSLGK (SEQ ID NO: 704) |
| Human IgG4 (S228P/ L235E) | 4.2 | ESKYGPPCPPCPAPEFEGGPSVFLFPPKPKDTLMISRTPEVTCVVV DVSQEDPEVQFNWYVDGVEVHNAKTKPREEQFNSTYRVVSVLTVLH QDWLNGKEYKCKVSNKGLPSSIEKTISKAKGQPREPQVYTLPPSQE EMTKNQVSLTCLVKGFYPSDIAVEWESNGQPENNYKTTPPVLDSDG SFFLYSRLTVDKSRWQEGNVFSCSVMHEALHNHYTQKSLSLSLGK (SEQ ID NO: 705) |

Example 10: SRF388 Binding Properties and IL-27 Receptor Blockade

The association and dissociation of recombinant human IL-27 at concentrations ranging from 0 to 5.0 µg/mL with an SRF388 concentration of 1 µg/mL were determined. Final binding kinetic parameters are shown in Table 14 along with binding model fit parameters (R2 and $\chi 2$) that demonstrate goodness of the model fitting to the data.

Human IL-27 displayed the strongest binding affinity for SRF388 of all species tested in this study (3.86 pM). Recombinant rat and cynomolgus monkey IL-27 also showed strong affinities for SRF388 with values of 80.9 and 37.4 pM, respectively, although somewhat weaker than the human protein. Recombinant mouse IL-27 had the weakest affinity for SRF388 by comparison with the human protein, with a value in the nM range (4.43 nM) as indicated by its slower association and faster dissociation rates.

TABLE 14

Data Summary for IL-27 Binding to SRF388 and Species Cross-Reactivity

| Analyte | $K_D$ (M) | $k_a$ (1/Ms) | $k_d$ (1/s) | Full $\chi^2$ | Full $R^2$ |
|---|---|---|---|---|---|
| Human IL-27 | 3.86E−12 | 5.10E+05 | 1.97E−06 | 0.4055 | 0.9991 |
| Mouse IL-27 | 4.43E−09 | 5.50E+04 | 2.44E−04 | 0.6732 | 0.9963 |
| Rat IL-27 | 8.09E−11 | 2.34E+06 | 1.89E−04 | 0.4685 | 0.9945 |
| Cynomolgus monkey IL-27 | 3.74E−11 | 3.18E+05 | 1.19E−05 | 1.3431 | 0.9979 |

Abbreviations: IL−27 = interleukin 27, $k_a$ = association constant, $k_d$ = dissociation constant, KD = binding affinity Note:
$R^2$ values > 0.95 and $\chi^2$ values < 3.0 are demonstrative of a good fit of the model to the data.

Example 11: CDR Sequence Alignments

A number of sub-selections of anti-IL-27 antibodies of the instant disclosure share sequence homology across their CDR regions, providing a diversity of variant CDR sequences that have been validated as retaining functionality. It is expressly contemplated herein that the following consensus CDR sequences are fully supported by—and are therefore within the scope of—the instant disclosure.

For SRF388, SRF381, SRF382, SRF384, SRF386 and SRF529 antibodies, alignments of the CDR sequences of each of these anti-IL-27 antibodies revealed extensive homology, punctuated by variable residues. In particular, heavy chain CDR1 alignments revealed the following variable residues:

```
              HCDR1 (IMGT)
CLUSTAL O(1.2.4) multiple sequence alignment

1       GFTFRSYG        8       (SEQ ID NO: 161)

5       GFTFRSYG        8       (SEQ ID NO: 73)

4       GETFASYG        8       (SEQ ID NO: 139)

2       GFTFSRTG        8       (SEQ ID NO: 95)

3       GFTFSRYG        8       (SEQ ID NO: 117)

6       GFTFSSYS        8       (SEQ ID NO: 51)
            ****
```

A consensus heavy chain CDR1 (IMGT) sequence for these homologous antibodies is therefore N-GFTF[S/A/R][S/R][T/Y][G/S]-C(SEQ ID NO: 412) and, accordingly, more generally contemplated herein as a consensus heavy chain CDR1 (IMGT) sequence is N-GFTFXXXX-C (SEQ ID NO: 408), where X is any amino acid residue.

Alignment of the SRF388, SRF381, SRF382, SRF384, SRF386 and SRF529 antibody heavy chain CDR2 (IMGT) sequences revealed the following:

```
              HCDR2 (IMGT)
CLUSTAL O(1.2.4) multiple sequence alignment

10       ISSSGSYI        8       (SEQ ID NO: 162)

11       ISSSSSYI        8       (SEQ ID NO: 140)

7       ISSSSSYI        8       (SEQ ID NO: 74)

9       ISSSSSYI        8       (SEQ ID NO: 96)

8       ISSSSAYI        8       (SEQ ID NO: 118)
```

-continued

```
              HCDR2 (IMGT)
CLUSTAL O(1.2.4) multiple sequence alignment

12       ISSSSSYI        8       (SEQ ID NO: 52)
            ****.:**
```

A consensus heavy chain CDR2 (IMGT) sequence for these homologous antibodies is therefore N-ISSS[S/G][S/A]YI-C(SEQ ID NO: 413) and, accordingly, more generally contemplated herein as a consensus heavy chain CDR2 (IMGT) sequence is N-ISSSXXYI-C(SEQ ID NO: 409), where X is any amino acid residue.

Alignments of the human CDR1 (NT) and human CDR2 (NT) sequences also revealed the following:

```
              HCDR1 (NT)
CLUSTAL O(1.2.4) multiple sequence alignment

13       FTFRSYGMN       9       (SEQ ID NO: 76)

16       FTFRSYGMN       9       (SEQ ID NO: 164)

17       FTFASYGMN       9       (SEQ ID NO: 142)

14       FTFSRTGMN       9       (SEQ ID NO: 98)

15       FTFSRYGMN       9       (SEQ ID NO: 120)

18       FTFSSYSMN       9       (SEQ ID NO: 54)
            ***    ***
```

```
                      HCDR2 (NT)
CLUSTAL O(1.2.4) multiple sequence alignment

23      GISSSGSYIYYADSVKG     17    (SEQ ID NO: 165)

19      SISSSSSYIYYADSVKG     17    (SEQ ID NO: 77)

20      SISSSSSYIYYADSVKG     17    (SEQ ID NO: 99)

22      SISSSSSYIYYADSVKG     17    (SEQ ID NO: 143)

21      SISSSSAYILYADSVKG     17    (SEQ ID NO: 121)

24      SISSSSSYIYYADSVKG     17    (SEQ ID NO: 55)
        .****.:** *******
```

Consensus heavy chain CDR1 (NT) and CDR2 (NT) sequences for these homologous antibodies are therefore N-FTF[S/A/R][S/R][T/Y][G/S]MN-C(SEQ ID NO: 414) and N-[G/S]ISSS[S/G][S/A]YI[L/Y]YADSVKG-C(SEQ ID NO: 415), respectively. In view of these consensus sequences, more generally contemplated herein are consensus heavy chain CDR1 (NT) and CDR2 (NT) sequences N-FTFXXXXMN-C(SEQ ID NO: 410) and N-XIS-SSXXYIXYADSVKG-C(SEQ ID NO: 411), respectively, where X is any amino acid residue.

Heavy chain CDR3 (IMGT or NT) and light chain CDRs CDR1 (IMGT or NT), CDR2 (IMGT or NT) and CDR3 (IMGT or NT) were fully conserved between SRF388, SRF381, SRF382, SRF384, SRF386 and SRF529.

Similar CDR sequence alignments performed upon SRF535 and SRF538 monoclonal antibodies revealed the following consensus CDR sequences for these two related antibodies:

```
Observed variation (IMGT):
HCDR1 (IMGT)
                                          (SEQ ID NO: 361)
N-GFTFSSYG-C HCDR2 (IMGT)
                                          (SEQ ID NO: 445)
N-I[K/W][Q/Y]DGS[E/N]K-C HCDR3 (IMGT)
                                          (SEQ ID NO: 446)
N-AR[D/G]AP[WDIYDYYM/EYV]DV-C LCDR1 (IMGT)
                                          (SEQ ID NO: 447)
N-QS[I/V]SSY-C LCDR2 (IMGT)
                                          (SEQ ID NO: 448)
N-[A/D][A/S]S-C LCDR3 (IMGT)
                                          (SEQ ID NO: 449)
N-QQ[S/Y][Y/S][V/L][P/Y]P[W/-]T-C Consensus (IMGT):
HCDR1 (IMGT)
                                          (SEQ ID NO: 361)
N-GFTFSSYG-C HCDR2 (IMGT)
                                          (SEQ ID NO: 436)
N-IXXDGSXK-C HCDR3 (IMGT)
                                          (SEQ ID NO: 437)
N-ARXAP[X]$_{n=3-8}$DV-C LCDR1 (IMGT)
                                          (SEQ ID NO: 438)
N-QSXSSY-C

LCDR2 (IMGT)
                                          (SEQ ID NO: 439)
N-XXS-C

LCDR3 (IMGT)
                                          (SEQ ID NO: 440)
N-QQXXXXP[X]$_{n=0-1}$T-C

Observed variation (NT):
HCDR1 (NT)
                                          (SEQ ID NO: 450)
N-FTFSSYGM[S/H]-C HCDR2 (NT)
                                          (SEQ ID NO: 451)
N-[N/V]I[K/W][Q/Y]DGS[E/N]KYY[V/A]DSVKG-C HCDR3 (NT)
                                          (SEQ ID NO: 446)
N-AR[D/G]AP[WDIYDYYM/EYV]DV-C LCDR1 (NT)
                                          (SEQ ID NO: 452)
N-RASQS[I/V]SSYL[N/A]-C LCDR2 (NT)
                                          (SEQ ID NO: 453)
N-[AA/D]SS[LQS/NRAT]-C LCDR3 (NT)
                                          (SEQ ID NO: 449)
N-QQ[S/Y][Y/S][V/L][P/Y]P[W/-]T-C Consensus (NT):
HCDR1 (NT)
                                          (SEQ ID NO: 441)
N-FTFSSYGMX-C HCDR2 (NT)
                                          (SEQ ID NO: 442)
N-XIXXDGSXKYYXDSVKG-C
HCDR3 (NT)
                                          (SEQ ID NO: 437)
N-ARXAP[X]$_{n=3-8}$DV-C LCDR1 (NT)
                                          (SEQ ID NO: 443)
N-RASQSXSSYLX-C LCDR2 (NT)
                                          (SEQ ID NO: 444)
N-[X]$_{n=1-2}$SS[X]$_{3-4}$-C LCDR3 (NT)
                                          (SEQ ID NO: 440)
N-QQXXXXP[X]$_{n=0-1}$T-C
```

Alignments of CDR sequences were also performed between the entirety of SRF388, SRF381, SRF382, SRF384, SRF386, SRF529, SRF535 and SRF538 antibodies, which resulted in the following observed variation and consensus sequences:

```
Observed variation (IMGT):
HCDR1 (IMGT)
                                          (SEQ ID NO: 454)
N-GFTF[S/A/R][S/R][T/Y][G/S]-C HCDR2 (IMGT)
                                          (SEQ ID NO: 455)
N-I[S/K/W][S/Q/Y][S/D][S/G][S/A][Y/E/N][I/K]-C
```

-continued

HCDR3 (IMGT)
(SEQ ID NO: 457)
N-AR[DGGRTSYTATAHNWF/DAPWDIYDYYM/GAPEYV]D[P/V]-C

LCDR1 (IMGT)
(SEQ ID NO: 459)
N-QS[VLF/I/V]SS[NNKN/-]Y-C

LCDR2 (IMGT)
(SEQ ID NO: 461)
N-[W/A/D][A/S]S-C

LCDR3 (IMGT)
(SEQ ID NO: 463)
N-QQ[H/S/Y][A/Y/S][S/V/L][A/P/Y]P[P/W/-]T-C

Consensus (IMGT):
HCDR1 (IMGT)
(SEQ ID NO: 408)
N-GFTFXXXX-C

HCDR2 (IMGT)
(SEQ ID NO: 456)
N-IXXXXXXX-C

HCDR3 (IMGT)
(SEQ ID NO: 458)
N-AR[X]$_{n=6-15}$DX-C

LCDR1 (IMGT)
(SEQ ID NO: 460)
N-QS[X]$_{n=1-3}$SS[X]$_{n=0-4}$Y-C

LCDR2 (IMGT)
(SEQ ID NO: 462)
N-XXS-C

LCDR3 (IMGT)
(SEQ ID NO: 464)
N-QQXXXXP[X]$_{n=0-1}$T-C

Observed variation (NT):
HCDR1 (NT)
(SEQ ID NO: 465)
N-FTF[S/A/R][S/R][T/Y][G/S]M[N/S/H]-C HCDR2 (NT)
(SEQ ID NO: 467)
N-[G/S/N/V]I[S/K/W][S/Q/Y][S/D][S/G][S/A][Y/E/N][I/K][L/Y]Y[V/A]DSVKG-C

HCDR3 (NT)
(SEQ ID NO: 469)
N-AR[D/G][GGRTSYTATAHNWF/APWDIYDYYM/APEYV]D[P/V]-C

LCDR1 (NT)
(SEQ ID NO: 471)
N-RASQS[I/V]SSYL[N/A]-C

LCDR2 (NT)
(SEQ ID NO: 473)
N-[WA/AA/D]S[TRES/SLQS/SNRAT]-C

LCDR3 (NT)
(SEQ ID NO: 475)
N-QQ[H/S/Y][A/Y/S][S/V/L][A/P/Y]P[P/W/-]T-C

Consensus (NT):
HCDR1 (NT)
(SEQ ID NO: 466)
N-FTFXXXXMX-C

HCDR2 (NT)
(SEQ ID NO: 468)
N-XIXXXXXXXXXYXDSVKG-C

HCDR3 (NT)
(SEQ ID NO: 470)
N-AR[X]$_{n=6-15}$DX-C

LCDR1 (NT)
(SEQ ID NO: 472)
N-RASQSXSSYLX-C

LCDR2 (NT)
(SEQ ID NO: 474)
N-[X]$_{n=1-2}$S[X]$_{n=4-5}$-C

LCDR3 (NT)
(SEQ ID NO: 476)
N-QQXXXXP[X]$_{n=0-1}$T-C

Alignments of SRF543 and SRF414 were also performed, and yielded the following observed variation and consensus sequences:

Observed variation (IMGT):
HCDR1 (IMGT)
(SEQ ID NO: 426)
N-GGSFS[R/D]Y[E/Y]-C

HCDR2 (IMGT)
(SEQ ID NO: 427)
N-ID[W/Y]SG[I/S]T-C

HCDR3 (IMGT)
(SEQ ID NO: 428)
N-AR[D/L][P/G][M/V]YY[-/Y]DSS[VSTGSV/DLGF]D[V/I]-C

LCDR1 (IMGT)
(SEQ ID NO: 429)
N-Q[S/D][V/I]S[S/N]Y-C

LCDR2 (IMGT)
(SEQ ID NO: 430)
N-D[S/A]S-C

LCDR3 (IMGT)
(SEQ ID NO: 431)
N-QQ[D/Y][S/D]D[H/L]PIT-C

Consensus (IMGT):
HCDR1 (IMGT)
(SEQ ID NO: 416)
N-GGSFSXYX-C

HCDR2 (IMGT)
(SEQ ID NO: 417)
N-IDXSGXT-C

HCDR3 (IMGT)
(SEQ ID NO: 418)
N-ARXXXYY[X]$_{n=0-1}$DSS[X]$_{n=4-6}$DX-C

LCDR1 (IMGT)
(SEQ ID NO: 419)
N-QXXSXY-C

LCDR2 (IMGT)
(SEQ ID NO: 420)
N-DXS-C

LCDR3 (IMGT)
(SEQ ID NO: 421)
N-QQXXDXPIT-C

Observed variation (NT):
HCDR1 (NT)
(SEQ ID NO: 432)
N-GSFS[R/D]Y[E/Y]WS-C

HCDR2 (NT)
(SEQ ID NO: 433)
N-SID[W/Y]SG[I/S]T[N/E]YNPSLKS-C

HCDR3 (NT)
(SEQ ID NO: 428)
N-AR[D/L][P/G][M/V]YY[-/Y]DSS[VSTGSV/DLGF]D[V/I]-C

-continued

```
LCDR1 (NT)
                                        (SEQ ID NO: 434)
N-[Q/R]ASQ[S/D][V/I]S[S/N]YL[N/A]-C

LCDR2 (NT)
                                        (SEQ ID NO: 435)
N-D[S/A]SN[R/L][A/E]T-C

LCDR3 (NT)
                                        (SEQ ID NO: 431)
N-QQ[D/Y][S/D]D[H/L]PIT-C

Consensus (NT):
HCDR1 (NT)
                                        (SEQ ID NO: 422)
N-GSFSXYWS-C HCDR2 (NT)
                                        (SEQ ID NO: 423)
N-SIDXSGXTXYNPSLKS-C HCDR3 (NT)
                                        (SEQ ID NO: 418)
N-ARXXXYY[X]$_{n=0-1}$DSS[X]$_{n=4-6}$DX-C LCDR1 (NT)
                                        (SEQ ID NO: 424)
N-XASQXXSXYLX-C

LCDR2 (NT)
                                        (SEQ ID NO: 425)
N-DXSNXXT-C

LCDR3 (NT)
                                        (SEQ ID NO: 421)
N-QQXXDXPIT-C
```

Example 12: Properties of Selected Monoclonal Antibodies

Selected monoclonal antibodies of the instant disclosure were assessed for various functional properties. The outcome of certain such assessment is tabulated in FIG. 9. Remarkably, a wide array of monoclonal antibodies were identified that exhibited binding to human IL-27 (as determined by surface plasmon resonance (SPR) technology in a BIACORE 2000 instrument, as described above) ("Property (i)") with an equilibrium dissociation constant (KD) of 15 nM or less, including Ab7, SRF557, SRF536, SRF416, SRF543, SRF414, SRF529, SRF381, SRF388, SRF382, SRF384, SRF386, SRF410, SRF411, SRF405, SRF535 and SRF538.

Unexpectedly, a selection of monoclonal antibodies were identified to be WSX-1 competitive ("Property (ii)"), including Ab7, SRF536, SRF416, SRF543, SRF414, SRF529, SRF381, SRF388, SRF382, SRF384, SRF386, SRF535 and SRF538.

Surprisingly, a selection of monoclonal antibodies were identified that inhibited pSTAT1 U937 ("Property (iii)"), including Ab7, SRF536, SRF416, SRF543, SRF414, SRF529, SRF381, SRF388, SRF382, SRF384, SRF386, SRF410, SRF411, SRF405, SRF535 and SRF538.

Remarkably, a selection of monoclonal antibodies were also identified that inhibited CD161 expression ("Property (iv)"), including Ab7, SRF536, SRF416, SRF543, SRF529, SRF381, SRF388, SRF382, SRF384 and SRF386.

A selection of monoclonal antibodies that, remarkably, inhibited PD-L1 expression in CD4$^+$ T cells ("Property (v)") were also identified, including Ab7, SRF536, SRF416, SRF543, SRF414, SRF529, SRF381, SRF388, SRF382, SRF384, SRF386 and SRF535.

While only tested for a limited number of monoclonal antibodies, variability in the ability of those antibodies tested to enhance PD-1-mediated cytokine secretion ("Property (vi)") was also observed. Specifically, SRF381 and SRF388 antibodies were remarkably identified to enhance PD-1-mediated cytokine secretion, whereas SRF536 did not.

Monoclonal antibodies possessing each of properties (i)-(vi), as recited above, have therefore been identified herein. Not all antibodies examined were identified to possess each of properties (i)-(vi), and it is therefore expressly contemplated that selections of antibodies can be assembled that possess a sub-selection of these properties. For example, antibodies Ab7, SRF536, SRF416, SRF543, SRF529, SRF381, SRF388, SRF382, SRF384 and SRF386 were identified to possess each of properties (i)-(v). Meanwhile, antibodies Ab7, SRF536, SRF416, SRF543, SRF529, SRF381, SRF388, SRF382, SRF384 and SRF386 were identified to possess each of properties (iii) and (iv). As will be apparent to the skilled artisan, similar sub-selections of antibodies and associated properties are readily assembled from the information presented in FIG. 9.

Example 13: Measurement of EBI3 and IL-27 in Serum from Human Patients

Figure 11A:
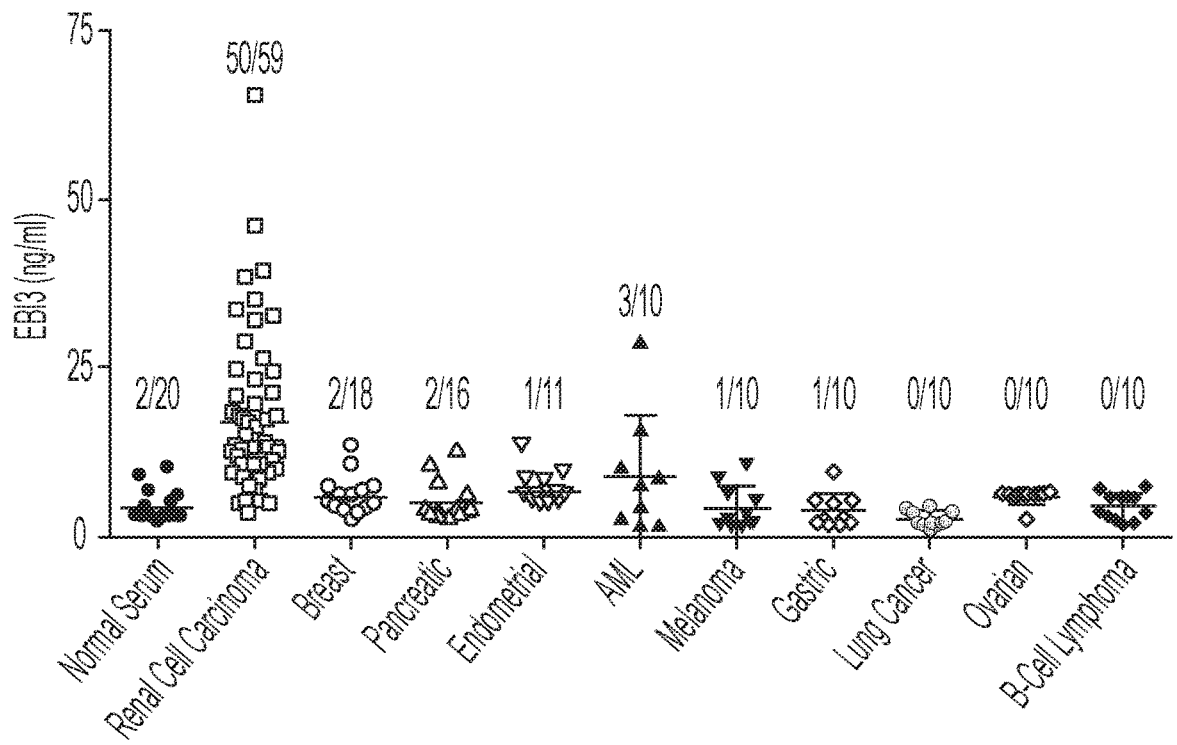
FIG. 11A is a dotplot showing serum levels of EBI3 or IL-27 in patients with cancer or healthy controls. Serum samples were tested for EBI3 (A) or IL-27 (B) levels using the antibody pairs described in Example 15. Values were extrapolated from a standard curve using recombinant human IL-27. The average+2 SD of healthy donors (normal controls) were used as an arbitrary cut-off for a serum sample to be considered positive. The total number of positive samples are indicated above the respective cancer classification.
Figure 11B:
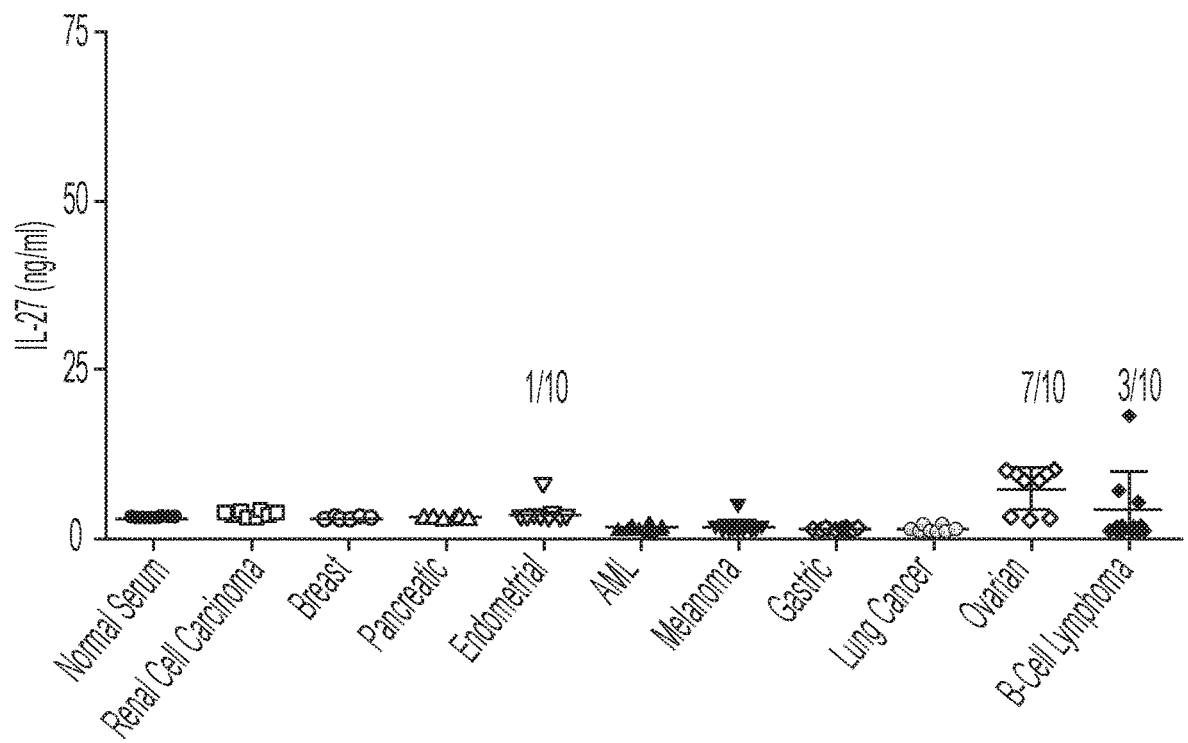
FIG. 11B is a dotplot showing that several ovarian cancer samples showed detectable levels of IL-27 in serum, which was also seen in serum from 3 patients with B-cell lymphoma and 1 patient with endometrial cancer, using the same parameter described for FIG. 11A.

In order to probe protein levels of EBI3 and IL-27 in serum or plasma, the novel antibody pairs for ELISA and MSD shown throughout FIGS. 11 and 12 were developed. Using the custom EBI3 ELISA several serum/plasma samples from patients with cancer were tested. The screening cohort was obtained from a commercial vendor and the level of EBI3 was calculated by extrapolation from a standard curve of recombinant human IL 27. Serum from pregnant women was used as a positive control for EBI3 detection as published previously (Devergne et al. Am J Pathol. 2001; 159(5):1763-76). Elevated levels of EBI3 were classified as being 2 standard deviations above the average of the healthy controls (normal serum). From this analysis, elevated levels of EBI3 appeared to be a common feature in patients with RCC while it was sporadically found in other cancer types tested. When these same samples were tested for levels of the IL-27 heterodimer, none of the RCC samples were positive or above the lower limit of quantitation of the assay based on detection of recombinant IL-27 (FIG. 11A). Several ovarian cancer samples showed detectable levels of IL-27 in serum, which was also seen in serum from 3 patients with B cell lymphoma and 1 patient with endometrial cancer (FIG. 11B). Since EBI3 levels were above the lower level of quantitation for the assay, additional experiments were pursued using this ELISA format. Further assay optimization for the IL-27 antibody pairs were conducted on the more sensitive MSD platform (described below).

Example 14: Generation and Characterization of a Human Anti-WSX-1 Antibody in Mice This Example describes the production of a human anti-WSX-1 antibody that specifically binds to the human IL-27 receptor WSX-1. Briefly, Harbour H2L2 mice (Harbour Biomed) were immunized with an immunization DNA vector encoding human WSX-1 (Aldevron) and hybridomas expressing anti-WSX-1 monoclonal antibodies were generated. Harbour H2L2 transgenic mice produce classical two heavy and two light immunoglobulin chain antibodies with fully human variable regions upon antigen challenge.

Following immunization of Harbour H2L2 mice, antigen-specific H2L2 monoclonal antibodies that specifically bind human IL-27 receptor WSX-1 were isolated using standard hybridoma technology. Briefly, following confirmation of WSX-1-positive titer from mouse serum, mouse spleens were removed and hybridoma cells were created using a typical fusion method. RNA was extracted from hybridoma cell pellets using an RNeasy Mini Kit (Qiagen, Cat. No. 74104). V-regions were amplified by RT-PCR using degenerate primer pools specific for human signal sequences together with rat constant region primers for each of IgG, IgM, IgA and Igκ. Heavy chain V-region (VH) mRNA was amplified using a set of seven degenerate primer pools (HA to HF). Light chain V-region mRNA was amplified using a set of three degenerate primer pools (KA to KC) specific for the K cluster and three primer pools (LA to LC) specific for the A cluster. The PCR products obtained from successful amplification were purified, cloned into a 'TA' cloning vector (pGEM-T Easy, Promega, Cat. No. A1360), transformed into *E. coli* and individual colonies sequenced, resulting in the identification and isolation of the anti-WSX-1 antibody 8B11. The amino acid sequences of the variable heavy chain and variable light chain of the 8B11 antibody are set forth in SEQ ID NO: 794 and SEQ ID NO: 796, respectively, in Table 12.

Example 15: Anti-IL-27 Antibodies Pair with the Anti-EBI3 Antibody Ab7 to Detect Recombinant Human IL-27

To improve the sensitivity and dynamic range of these assays, the EBI3 and IL-27 antibody pairs were optimized on the MSD platform. In doing so, the lower level of quantitation was decreased to 80 pg/mL and 630 pg/mL from ~2.5 ng/mL for both EBI3 and IL 27, respectively. This MSD platform was then utilized to probe an additional cohort of serum and plasma samples obtained from a commercial vendor for detection of IL-27 and EBI3.

The concentration of interleukin 27 (IL-27) and Epstein-Barr virus induced 3 (EBI3) in serum samples from patients with multiple cancer types and serum samples from healthy donors was determined. A total of 174 serum samples obtained from BioIVT (15 renal cell carcinoma [RCC], 15 ovarian cancer, 10 hepatocellular carcinoma [HCC], 15 acute myeloid leukemia [AML], 15 diffuse large B-cell lymphoma [DLBCL], 14 sarcoma, 15 melanoma, 15 head and neck squamous cell carcinoma [HNSCC], 10 Hodgkin lymphoma, 15 gastric cancer, 1 testicular cancer, 15 endometrial cancer, and 19 healthy donors) were evaluated. Serum concentrations of IL-27 and EBI3 were determined using a Meso Scale Discovery (MSD) assay. Briefly, the concentrations of IL-27 and EBI3 were determined using a standard curve constructed with a recombinant human IL-27 protein over the range of 0 to 723 ng/mL. The capture and detection antibody pair for IL-27 MSD were the anti-p28 antibody SRF381 and the anti-EBI3 antibody Ab7. The capture and detection antibody pair for EBI3 MSD were the anti-EBI3 antibody SRF557 and the anti-EBI3 antibody Ab7. A SULFO-TAG labeled goat anti-mouse antibody was used as the detection antibody, and plates were read on a MESO QUICKPLEX SQ120.

Figure 12A:
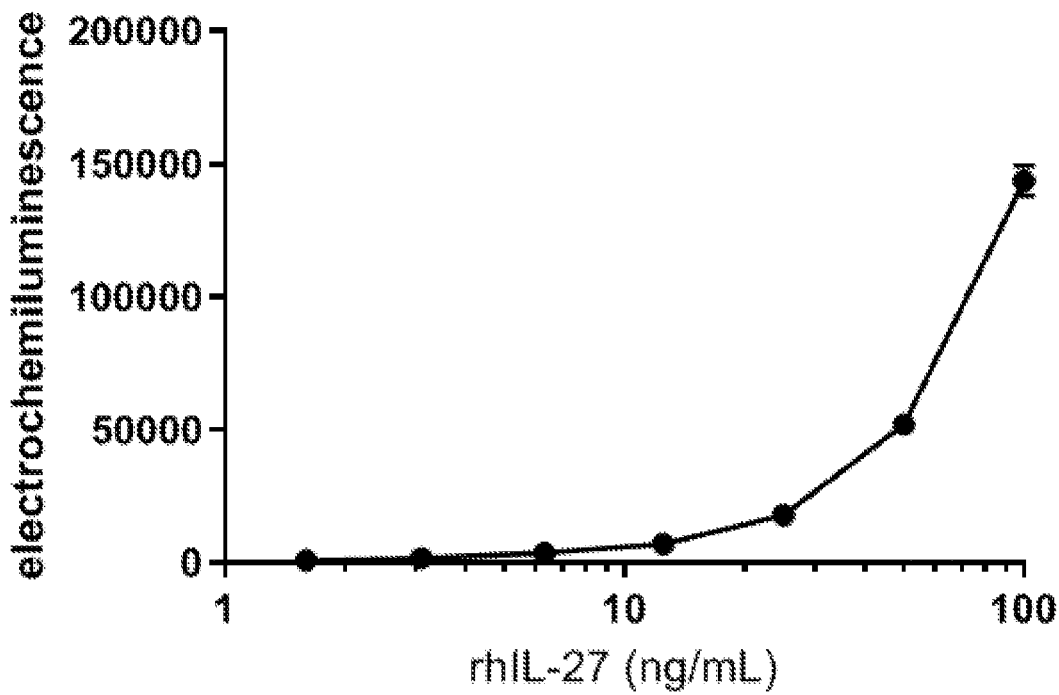
FIG. 12A is a graph showing that the anti-p28 capture antibody SRF381 pairs with the anti-EBI3 antibody Ab7 to detect recombinant human IL-27 by MSD immunoassay in an IL-27 concentration dependent manner.
Figure 12B:
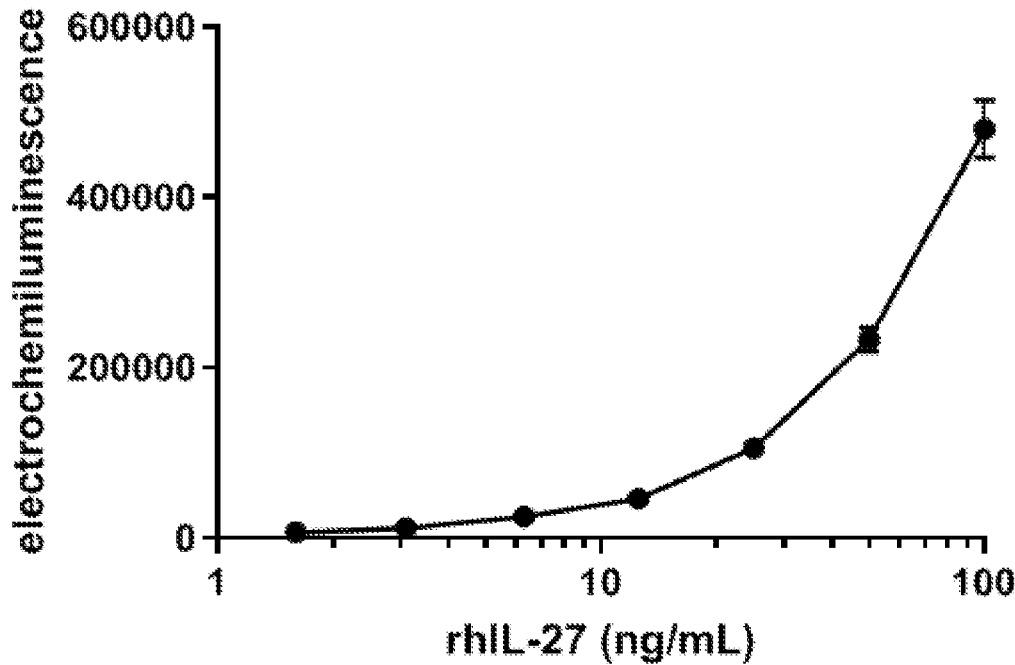
FIG. 12B is a graph showing that the anti-EBI3 capture antibody SRF557 pairs with the anti-EBI3 antibody Ab7 to detect recombinant human IL-27 by MSD immunoassay in an IL-27 concentration dependent manner.

The ability of anti-IL-27 antibodies to pair with the anti-EBI3 antibody Ab7 to detect recombinant human IL-27 was assessed by sandwich ELISA. FIG. 12A shows binding of anti-IL-27 antibody SRF381 to recombinant human IL-27 with detection by Ab7 as measured by sandwich ELISA. FIG. 12B shows binding of anti-IL-27 antibodies to recombinant human IL-27 with detection by SRF381 as measured by MSD Sandwich Immunoassay.

Figure 12C:
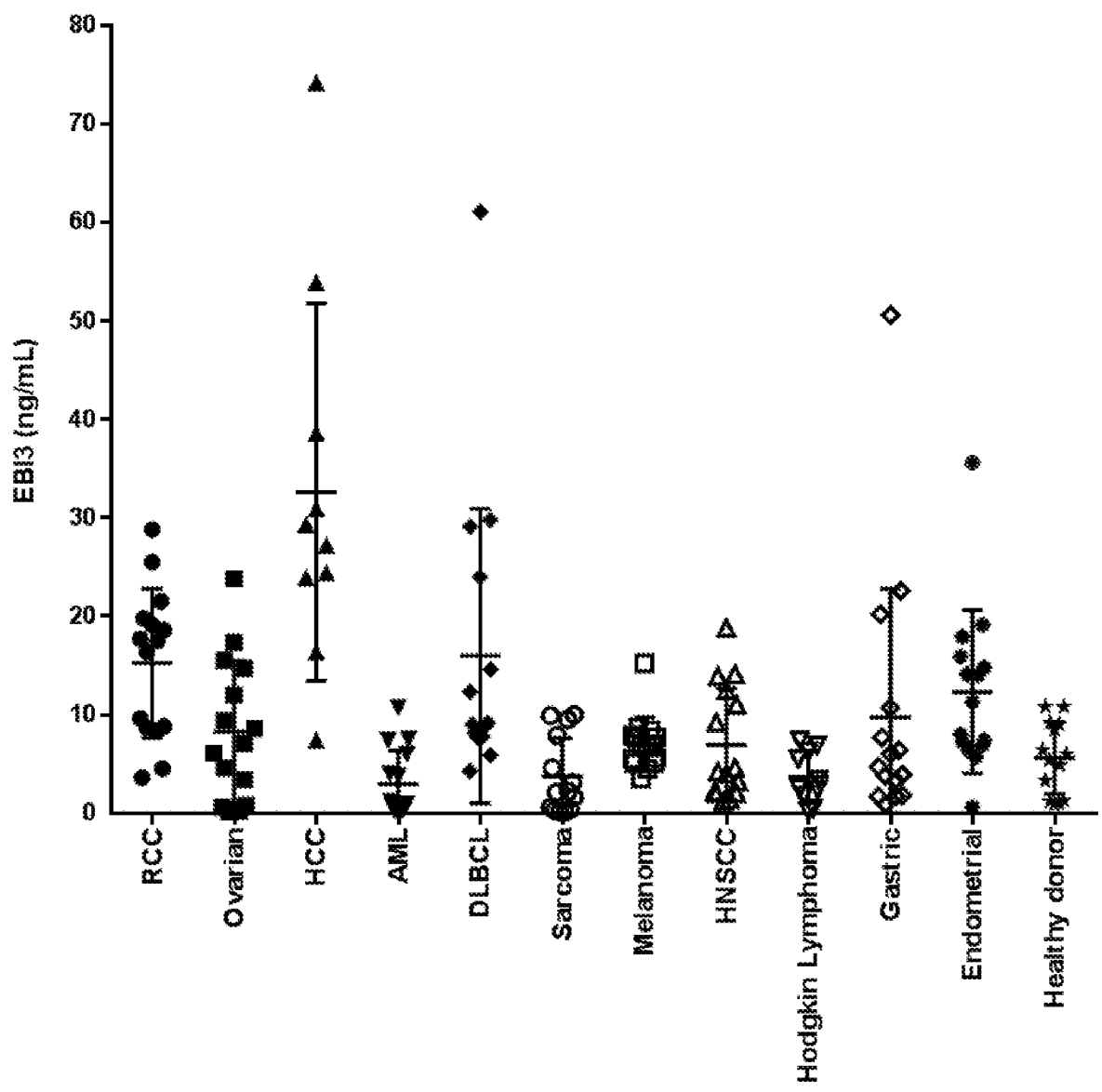
FIGS. 12C-12D are graphs showing the concentration EBI3 (FIG. 12C) and IL-27 (FIG. 12D) in 174 serum samples from cancerous (renal cell carcinoma (RCC), ovarian, hepatocellular carcinoma (HCC), acute myeloid leukemia (AML), diffuse large B-cell lymphoma (DLBCL), sarcoma, melanoma, head and neck squamous cell carcinoma (HNSCC), Hodgkin lymphoma, gastric, endometrial and healthy (normal) patients, as determined by Meso Scale Discovery (MSD) assay.
Figure 12D:
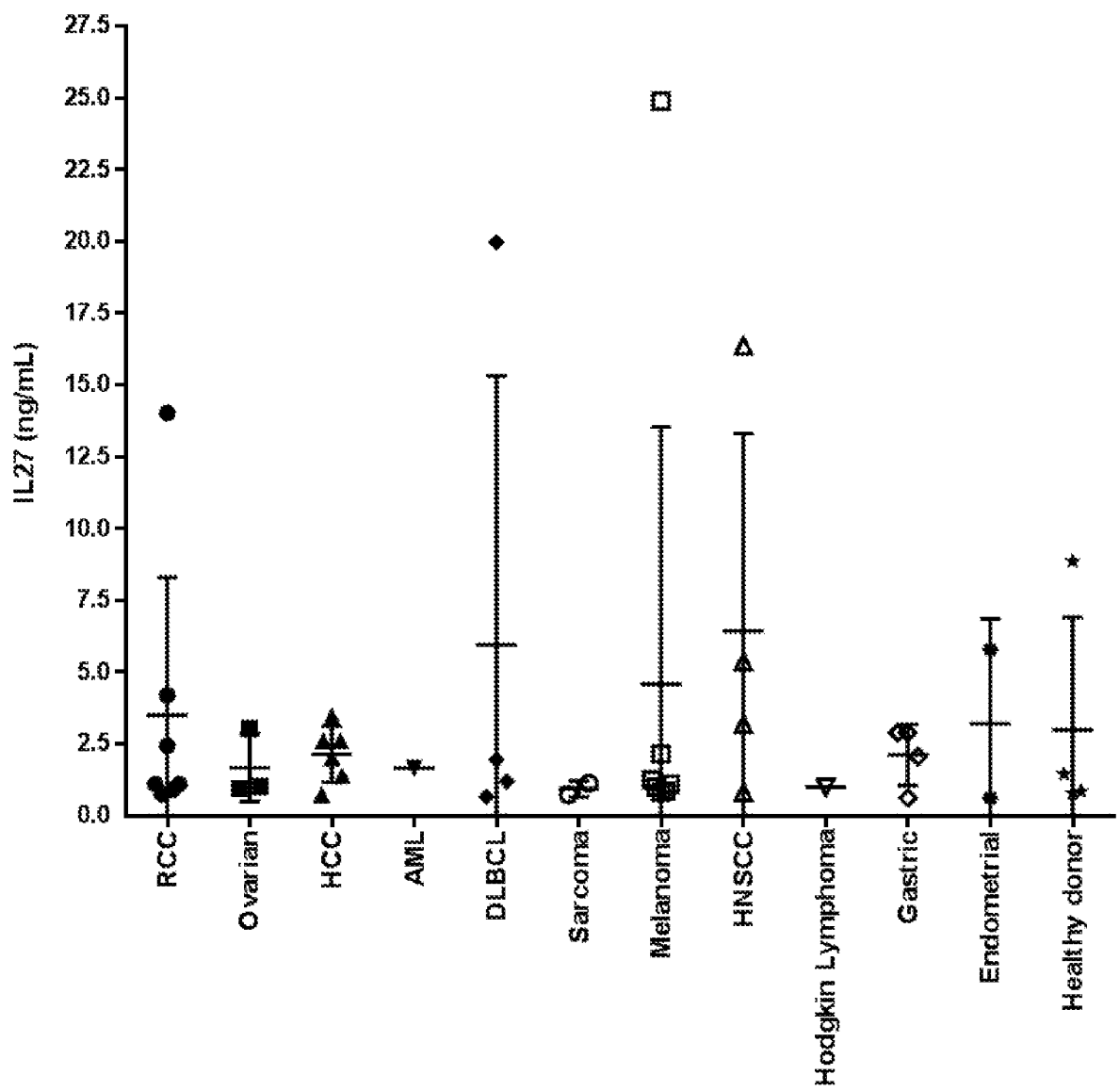

Consistent with the observations made by ELISA, several patients with RCC (9 of 15) showed levels of EBI3 by MSD detection that were higher than the level seen in healthy donors (>average+2 SD) (FIGS. 12C-12D). Several other cancer types were explored based on either tumor transcript levels of EBI3 or p28 in TCGA or cancers that are known to be associated with viral infection, an immune stimulus known to drive EBI3 and p28 expression.29 Of these groups, EBI3 levels were almost uniformly increased in hepatocellular carcinoma, and close to 50 percent of patients with endometrial cancer (7 of 15).

Figure 12E:
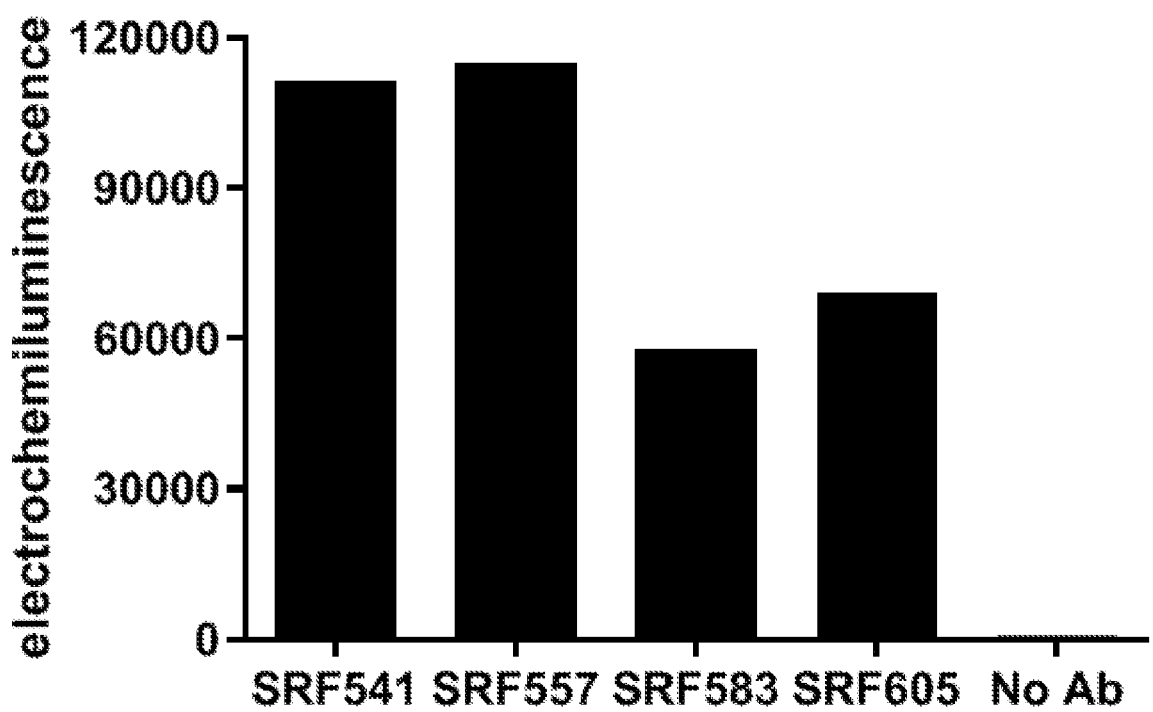
FIG. 12E is a bar graph showing that anti-IL-27 antibodies can pair with SRF381 to detect recombinant human IL-27 by MSD immunoassay.
Figure 12F:
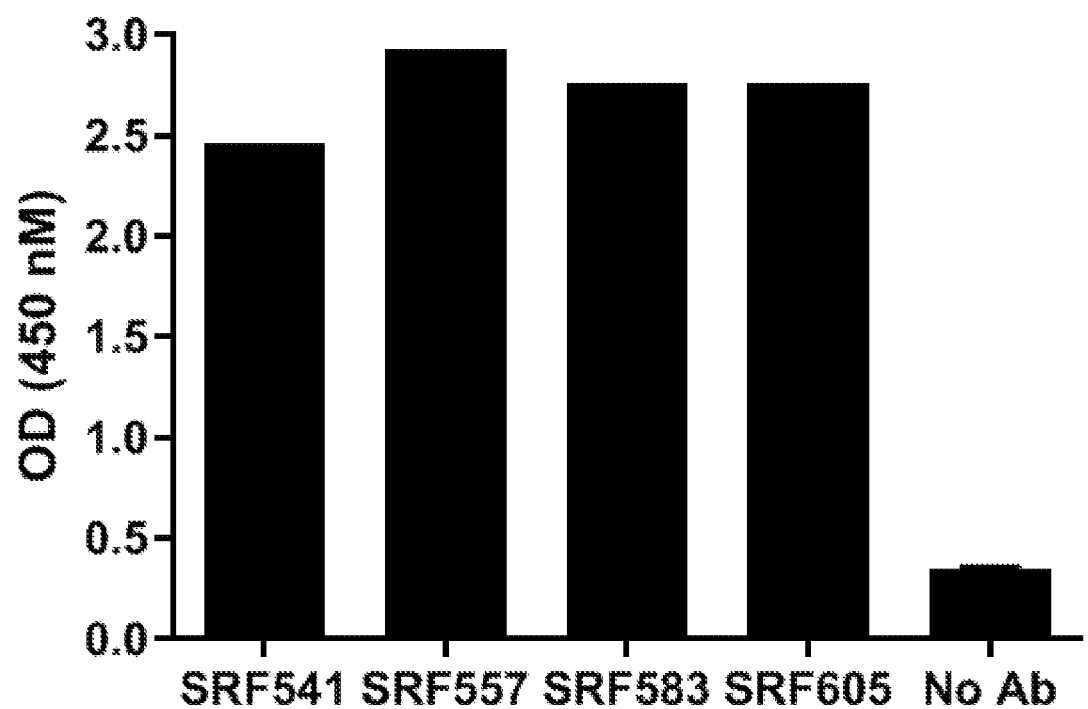
FIG. 12F is a bar graph showing that anti-IL-27 antibodies can pair with Ab7 to detect recombinant human IL-27 by ELISA.

FIG. 12E shows detection of recombinant human IL-27 by MSD Sandwich Immunoassay using SRF381 as capture and Ab7 as detection. FIG. 12F shows detection of recombinant human IL-27 by MSD Sandwich Immunoassay using SRF557 as capture and Ab7 as detection.

With the improved sensitivity of the IL-27 MSD assay, serum levels were detected above the lower level of quantitation in 38 of 155 samples tested. Four samples had concentrations >10 ng/mL (1 each from RCC, diffuse large B cell lymphoma, melanoma, and head and neck squamous cell carcinoma [HNSCC]) while several HCC (5 of 10), melanoma (7 of 15), and HNSCC (5 of 15) samples had detectable levels of IL-27 above the lower limit of quantitation. These data are summarized below in Table 5 and Table 6 for levels of IL-27 and EBI3, respectively. Thus, the MSD format provided increased sensitivity for detecting IL-27 in serum; however, the levels are consistently lower than what can be detected for EBI3, suggesting that the EBI3 subunit is found in excess.

TABLE 15

Distribution of IL-27 Concentrations in Serum from Patients with Cancer and Healthy Donors

| Serum Sample Type | Number of Samples | Number of Samples > LLOQ | Range (ng/mL) | Average ± SD (ng/mL)[a] |
|---|---|---|---|---|
| RCC | 15 | 7 (47%) | 0.76-14.01 | 3.5 ± 4.8 |
| Ovarian | 15 | 3 (20%) | 0.96-3.04 | 1.7 ± 1.2 |
| HCC | 10 | 5 (50%) | 1.40-3.47 | 2.4 ± 0.8 |
| AML | 15 | 1 (7%) | 1.68 | NA |
| DLBCL | 15 | 4 (27%) | 0.67-19.99 | 6.0 ± 9.4 |
| Sarcoma | 14 | 2 (14%) | 0.74-1.14 | 0.9 ± 0.3 |
| Melanoma | 15 | 7 (47%) | 0.83-24.90 | 4.6 ± 9.0 |
| HNSCC | 15 | 4 (27%) | 0.82-16.37 | 6.4 ± 6.9 |
| Hodgkin | 10 | 1 (10%) | 1.01 | NA |
| Gastric | 15 | 3 (20%) | 2.07-2.91 | 2.6 ± 0.5 |
| Endometrial | 15 | 2 (13%) | 0.63-5.79 | 3.2 ± 3.6 |
| Testicular | 1 | 0 | NA | NA |
| All Cancers | 155 | 39 (25%) | 0.63-24.90 | 3.6 ± 5.5 |
| Healthy Donor | 14 | 4 (29%) | 0.80-8.86 | 3.0 ± 3.9 |

Abbreviations: AML = acute myeloid leukemia, DLBCL = diffuse large B-cell lymphoma, HCC = hepatocellular carcinoma, HNSCC = head and neck squamous cell carcinoma, Hodgkin = Hodgkin lymphoma, IL-27 = interleukin 27, LLOQ = lower limit of quantitation, NA = not applicable, RCC = renal cell carcinoma, SD = standard deviation
[a]Average IL-27 levels were calculated using all values from each serum sample type that had 2 replicate values above the LLOQ.

TABLE 16

Distribution of EBI3 Concentrations in Serum from Patients with Cancer and Healthy Donors

| Serum Sample Type | Number of Samples[a] | Number of Samples > HD Average + 2 SDs[b] | Range (ng/mL) | Average ± SD (ng/mL) |
|---|---|---|---|---|
| RCC | 15 | 9 (60%) | 3.6-28.8 | 15.2 ± 7.6[c] |
| Ovarian | 15 | 4 (27%) | 0.1-23.8 | 8.3 ± 7.2 |
| HCC | 10 | 9 (90%) | 7.4-74.3 | 32.6 ± 19.2[c] |
| AML | 15 | 0 | 0.2-10.7 | 3.0 ± 3.4 |
| DLBCL | 15 | 5 (33%) | 4.3-61.1 | 16.0 ± 14.9[c] |
| Sarcoma | 14 | 0 | 0.1-10.0 | 3.7 ± 3.9 |
| Melanoma | 15 | 1 (7%) | 3.5-15.2 | 7.0 ± 2.7 |
| HNSCC | 15 | 3 (20%) | 1.2-18.8 | 6.9 ± 5.7 |
| Hodgkin | 10 | 0 | 0.2-7.4 | 3.7 ± 2.7 |
| Gastric | 15 | 3 (20%) | 0.9-50.6 | 9.7 ± 13.0 |
| Endometrial | 15 | 7 (47%) | 0.7-35.6 | 12.3 ± 8.3[c] |
| Testicular | 1 | 0 | 8.6 | NA |
| All Cancers | 155 | 41 (26%) | 0.1-74.3 | 10.3 ± 11.5 |
| HD | 14 | 0 | 1.0-10.9 | 5.6 ± 3.7 |

Abbreviations: AML = acute myeloid leukemia, DLBCL = diffuse large B-cell lymphoma, EBI3 = Epstein-Barr virus induced gene 3, HCC = hepatocellular carcinoma, HD = healthy donor, HNSCC = head and neck squamous cell carcinoma, Hodgkin = Hodgkin lymphoma, LLOQ = lower limit of quantitation, NA = not applicable, RCC = renal cell carcinoma, SD = standard deviation
[a]All serum samples had levels of EBI3 above the LLOQ.
[b]HD average + 2 SDs EBI3 concentration = ~13 ng/mL.
[c]Statistically significant increase in EBI3 concentration compared to HD by unpaired t-test. RCC vs HD: p = 0.0002; HCC vs HD: p < 0.0001; DLBCL vs HD: p = 0.0180; and endometrial vs HD: p = 0.0098.

These data collectively suggest that elevated levels of circulating EBI3 are commonly found in patients with RCC and HCC; however, this EBI3 does not appear to be exclusively complexed with p28 in the serum/plasma. A similar finding has been shown for the heterodimeric cytokines IL-12 or IL-23 where the p40 subunit common to both molecules can be found circulating as a monomer in excess of, and independent of the p19 or p35 heterodimer pairs. It has been speculated that localized expression of the heterodimer subunit may spatially restrict the biological activity of the heterodimer.

Sandwich Assays

Nunc MaxiSorp ELISA Plates (Affymetrix #44-2404-21) were coated with 100 μL/well anti-IL-27 antibodies (0.5 μg/mL diluted in PBS) sealed and incubated overnight at 4° C. These capture antibodies include, for example, anti-p28 antibodies (e.g., SRF381, SRF529, SRF388, SRF382, SRF384, SRF386, SRF605, SRF535, SRF538) or anti-EBI3 antibodies (e.g., SRF557, SRF536, SRF416, SRF543, SRF414, SRF541, and Ab7), or anti-IL-27 antibodies (e.g. SRF583, SRF410, SRF411, SRF405 and SRF573 Plates were washed 3 times with 100 μL/well of wash buffer (PBS+0.01% Tween). Plates were then blocked with 200 μL/well of blocking buffer (PBS+0.1% BSA+0.01% Tween) for 1 hour at room temperature (RT) with shaking. Blocking buffer was decanted, plates were washed 3 times with 100 μL/well of wash buffer, and 100 μL of recombinant human IL-27 (R&D Systems 2526-IL/CF) (100 ng/mL diluted in blocking buffer) was added to each well. Plates were decanted, washed 3 times with 100 μL/well of wash buffer, and 100 μL/well of biotinylated detection antibodies (1 μg/mL diluted in blocking buffer) was added for 1 hour at RT with shaking. Detection antibodies include, for example, anti-p28 antibodies (e.g., SRF381, SRF529, SRF388, SRF382, SRF384, SRF386, SRF605, SRF535, SRF538) or anti-EBI3 antibodies (e.g., SRF557, SRF536, SRF416, SRF543, SRF414, SRF541, and Ab7), or anti-IL-27 antibodies (e.g. SRF583, SRF410, SRF411, SRF405 and SRF573), (Specific combinations of antibodies to detect IL-27 heterodimer, EBI3, and p28 are listed in Tables 17-19 below.) Detection antibody was decanted, plates were washed 3 times with 100 μL/well of wash buffer, and 100 μL/well Streptavidin HRP (Abcam ab7403) (1:5000 diluted in blocking buffer) was added for 1 hour at RT with shaking. Plates were washed 3 times with 100 μL/well of wash buffer, 100 μL/well of TMB buffer (Life Technologies #00-2023) was added for 10 minutes at RT and, 50 μL/well of Stop solution (Thermo Fisher #SS04) was added. Plates were read at 450 nm within 30 minutes of stopping the reaction.

TABLE 17

IL-27 Heterodimer ELISA Antibody Combinations
Anti-p28 antibody and anti-EBI3 antibody combinations that may be used in the method to detect IL-27 as described in Example 15 are set forth in Table 17. In addition, anti-IL-27 antibody SRF583, SRF410, SRF411, SRF405 and SRF573 may each be used in combination with any one of Ab7, SRF557, SRF536, SRF416, SRF543, SRF414, SRF541, SRF529, SRF381, SRF388, SRF382, SRF384, SRF386, SRF605, SRF535, and SRF538.

| Anti-EBI3 Antibody | Anti-p28 Antibody Combinations |
|---|---|
| Ab7 | SRF529, SRF381, SRF388, SRF382, SRF384, SRF386, SRF605, SRF535, SRF538 |
| SRF557 | SRF529, SRF381, SRF388, SRF382, SRF384, SRF386, SRF605, SRF535, SRF538 |
| SRF536 | SRF529, SRF381, SRF388, SRF382, SRF384, SRF386, SRF605, SRF535, SRF538 |
| SRF416 | SRF529, SRF381, SRF388, SRF382, SRF384, SRF386, SRF605, SRF535, SRF538 |
| SRF543 | SRF529, SRF381, SRF388, SRF382, SRF384, SRF386, SRF605, SRF535, SRF538 |
| SRF414 | SRF529, SRF381, SRF388, SRF382, SRF384, SRF386, SRF605, SRF535, SRF538 |
| SRF541 | SRF529, SRF381, SRF388, SRF382, SRF384, SRF386, SRF605, SRF535, SRF538 |

TABLE 18

EBI3 ELISA Antibody Combinations
EBI3 antibody combinations that can be used
in the method to detect EBI3 as described
in Example 15 are set forth in Table 18.

| Anti-EBI3 Antibody | Anti-EBI3 Antibody Combinations |
|---|---|
| Ab7 | SRF557, SRF541 |
| SRF557 | Ab7, SRF536, SRF416, SRF543, SRF414, SRF541 |
| SRF536 | SRF557, SRF541 |
| SRF416 | SRF557, SRF541 |
| SRF543 | SRF557, SRF541 |
| SRF414 | SRF557, SRF541 |
| SRF541 | Ab7, SRF536, SRF416, SRF543, SRF414, SRF557 |

TABLE 19

P28 ELISA Antibody Combinations
P28 antibody combinations that can be used
in the method to detect p28 as described in
Example 15 are set forth in Table 19.

| Anti-p28 Antibody | Anti-p28 Antibody Combinations |
|---|---|
| SRF605 | SRF529, SRF381, SRF388, SRF382, SRF384, SRF386, SRF535, SRF538 |

The ability of anti-IL-27 antibodies to pair with the anti-p28 antibody SRF381 to detect recombinant human IL-27 was assessed by sandwich MSD Immunoassay. Briefly, MSD QUICKPLEX 96-well plates (Meso Scale Discovery L55XA) were coated with 50 µL/well anti-IL-27 antibodies (0.5 µg/mL diluted in PBS) sealed and incubated overnight at 4° C. Plates were washed 3 times with 150 µL/well of wash buffer (PBS+0.01% Tween). Plates were then blocked with 200 µL/well of blocking buffer (PBS+1% BSA+0.01% Tween) for 1 hour at room temperature (RT) with shaking. Blocking buffer was decanted, plates were washed 3 times with 150 µL/well of wash buffer, and 50 µL/well recombinant human IL-27 (R&D Systems 2526-IL/CF) (500 ng/mL diluted in blocking buffer) was added to each well for 2 hours at RT with shaking. Plates were washed 3 times with 150 µL/well of wash buffer, and 50 µL biotinylated SRF381 (diluted 0.5 µg/mL in blocking buffer) was added to each well for 1 hour at RT with shaking. Plates were washed 3 times with 150 µL/well of wash buffer and 50 µL/well SULFO-TAG labeled streptavidin (Meso Scale Discovery R92TC-1) (1:1000 diluted in blocking buffer) was added to each well for 30 minutes at RT with shaking. Plates were washed 3 times with 150 µL/well of wash buffer and 150 µL of MSD read buffer (Meso Scale Discovery R92TC-1) (diluted to 2× in deionized water) was added to each well and plates were read on a MESO QUICKPLEX SQ120.

Immunoassays

MSD QUICKPLEX 96-well plates (Meso Scale Discovery L55XA) were coated with 50 µL/well of either SRF381 or SRF557 (0.5 µg/mL diluted in PBS) sealed and incubated overnight at 4° C. Plates were washed 3 times with 150 µL/well of wash buffer (PBS+0.01% Tween). Plates were then blocked with 200 µL/well of blocking buffer (PBS+1% BSA+0.01% Tween) for 1 hour at room temperature (RT) with shaking. Blocking buffer was decanted, plates were washed 3 times with 150 µL/well of wash buffer, and 50 µL/well recombinant human IL-27 (R&D Systems 2526-IL/CF) diluted in blocking buffer was added to each well for 2 hours at RT with shaking. An 8-point 2-fold serial dilution IL-27 standard curve was created starting at 100 ng/mL. Plates were washed 3 times with 150 µL/well of wash buffer, and 50 µL Ab7 (diluted 0.5 µg/mL in blocking buffer) was added to each well for 1 hour at RT with shaking. Plates were washed 3 times with 150 µL/well of wash buffer and 50 µL/well MSD SULFO-TAG conjugated goat anti-mouse antibody (Meso Scale Discovery R32AC-5) (1:1000 diluted in blocking buffer) was added to each well for 30 minutes at RT with shaking. Plates were washed 3 times with 150 µL/well of wash buffer and 150 µL of MSD read buffer (Meso Scale Discovery R92TC-1) (diluted to 2× in deionized water) was added to each well and plates were read on a MESO QUICKPLEX SQ120.

SEQUENCE LISTING (807 sequences)

SEQ ID NO: 1 - protein, 121 aa, Artificial
  Synthetic
EVKLVESGGGLVQPGGSLKLFCAASGFTFTSYSMSWVRQTPEKRLEWVAYISYDGGSAYYPDTVKGRFSISRDNAKKTLYLQMSSLKSEDTAMYYCARHGDYDDDDAMDYWGQGTSVTVSS

SEQ ID NO: 2 - DNA, 363 bp, Artificial
  Synthetic
gaggtgaagctggtggagtctgggggaggcttggtacagcctggggggtccctgaaactcttctgtgcagcctctggattcacctttaccagctattccatgagctgggtccgccagactccagagaagaggctggagtgggtcgcatacattagttatgatggtggtagcgcctactaccctgacactgtgaagggccggttctccatctccagagacaatgccaagaaaaccctgtatctgcaaatgagcagcctgaagtctgaggacacggccatgtattactgtgcaagacatggagactatgacgacgacgacgcgatggactactggggccaaggaacctcagtcaccgtctcctca

SEQ ID NO: 3 - protein, 107 aa, Artificial
  Synthetic
DIQMTQSPASLSASVGETVTITCRASENIYSYLAWYQQKQGKSPQLLVYNAETLTEGVPSRFSGSGSGTQFSLKINSLQPEDFGNYYCQHHYGTPLTFGAGTKLDLK

SEQ ID NO: 4 - DNA, 321 bp, Artificial
  Synthetic
gacatccagatgacccagtctccagcctccctgtctgcatctgtaggagaaactgtcaccatcacttgccgggcaagtgagaacatttacagctatttagcatggtatcagcagaaacaggggaaatctcctcagctcctggtctataatgcagaaaccttgacagaaggggtcccatcaaggttcagcggcagtggatctgggacacaattctctctcaagatcaacagtctgcaacctgaagattttgggaattactactgtcaacatcattacggtaccccgctcacattcggcgctgggaccaagctggatctgaaa

SEQ ID NO: 5 - protein, 121 aa, Artificial
  Synthetic
EVKLVESGGGLVQPGGSLRLSCAASGFTFTSYSMSWVRQAPGKGLEWVAYISYDGGSAYYPDTVKGRFTISRDNSKKTLYLQMSSLKSEDTAMYYCARHGDYDDDDAMDYWGQGTSVTVSS

SEQ ID NO: 6 - DNA, 363 bp, Artificial
  Synthetic
gaggtgaagctggtggagtctgggggaggcttggtacagcctggggggtccctgagactctcctgtgcagcctctggattcacctttaccagctattccatgagctgggtccgccaggctccagggaaggggctggagtgggtcgcatacattagttatgatggtggtagcgcctactaccctgacactgtgaagggccggttcaccatctccagagacaattccaagaaaaccctgtatctgcaaatgagcagcctgaagtctgaggacacggccatgtattactgtgcaagacatggagactatgacgacgacgacgcgatggactactggggccaaggaacctcagtcaccgtctcctca

SEQ ID NO: 7 - protein, 121 aa, Artificial
  Synthetic
EVQLVESGGGLVQPGGSLRLSCAASGFTFTSYSMSWVRQAPGKGLEWVAYISYDGGSAYYPDTVKGRFTISRDNSKNTLYLQMSSLKSEDTAMYYCARHGDYDDDDAMDYWGQGTLVTVSS

SEQ ID NO: 8 - DNA, 363 bp, Artificial
  Synthetic
gaggtgcagctggtggagtctgggggaggcttggtacagcctggggggtccctgagactctcctgtgcagcctctggattcacctttaccagctattccatgagctgggtccgccaggctccagggaaggggctggagtgggtcgcatacattagttatgatggtggtagcgcctactaccctgacactgtgaagggccggttcaccatctccagagacaattccaagaacaccctgtatctgcaaatgagcagcctgaagtctgaggacacggccatgtattactgtgcaagacatggagactatgacgacgacgacgcgatggactactggggccaaggaaccctggtcaccgtctcctca

SEQ ID NO: 9 - protein, 121 aa, Artificial
  Synthetic
EVKLVESGGGLVQPGGSLRLSCAASGFTFTSYSMSWVRQAPGKGLEWVAYISYDGGSAYYPDTVKGRFTISRDNSKKTLYLQMNSLRAEDTAVYYCARHGDYDDDDAMDYWGQGTLVTVSS

SEQ ID NO: 10 - DNA, 363 bp, Artificial
  Synthetic
gaggtgaagctggtggagtctgggggaggcttggtacagcctggggggtccctgagactctcctgtgcagcctctggattcacctttaccagctattccatgagctgggtccgccaggctccagggaaggggctggagtgggtcgcatacattagttatgatggtggtagcgcctactatcctgacactgtgaagggccggttcaccatctccagagacaattccaagaaaaccctgtatctgcaaatgaacagcctgagagccgaggacacggccgtatattactgtgcaagacatggagactatgacgacgacgacgcgatggactactggggccaaggaaccctggtcaccgtctcctca

SEQ ID NO: 11 - protein, 121 aa, Artificial
  Synthetic
EVQLVESGGGLVQPGGSLRLSCAASGFTFTSYSMSWVRQAPGKGLEWVAYISYDGGSAYYPDTVKGRFTISRDNSKNTLYLQMNSLRAEDTAVYYCARHGDYDDDDAMDYWGQGTLVTVSS

SEQ ID NO: 12 - DNA, 363 bp, Artificial
  Synthetic
gaggtgcagctggtggagtctgggggaggcttggtacagcctggggggtccctgagactctcctgtgcagcctctggattcacctttaccagctattccatgagctgggtccgccaggctccagggaaggggctggagtgggtcgcatacattagttatgatggtggtagcgcctactatcctgacactgtgaagggccggttcaccatctccagagacaattccaagaacaccctgtatctgcaaatgaacagcctgagagccgaggacacggccgtatattactgtgcaagacatggagactatgacgacgacgacgcgatggactactggggccaaggaaccctggtcaccgtctcctca

SEQ ID NO: 13 - protein, 121 aa, Artificial
  Synthetic
EVQLVESGGGLVQPGGSLRLSCAASGFTFTSYSMSWVRQAPGKGLEWVSYISYDGGSAYYPDTVKGRFTISRDNSKNTLYLQMNSLRAEDTAVYYCARHGDYDDDDAMDYWGQGTLVTVSS

SEQ ID NO: 14 - DNA, 363 bp, Artificial
  Synthetic
gaggtgcagctggtggagtctgggggaggcttggtacagcctggggggtccctgagactctcctgtgcagcctctggattcacctttaccagctattccatgagctgggtccgccaggctccagggaaggggctggagtgggtgtcttacattagttatgatggtggtagcgcctactatcctgacactgtgaagggccggttcaccatctccagagacaattccaagaacaccctgtatctgcaaatgaacagcctgagagccgaggacacggccgtatattactgtgcaagacatggagactatgacgacgacgacgcgatggactactggggccaaggaaccctggtcaccgtctcctca

SEQ ID NO: 15 - protein, 107 aa, Artificial
  Synthetic
DIQMTQSPSSLSASVGDRVTITCRASENIYSYLAWYQQKQGKAPKLLVYNAETLTEGVPSRFSGSGSGTDFTLTISSLQPEDFANYYCQHHYGTPLTFGQGTKLDIK

SEQ ID NO: 16 - DNA, 321 bp, Artificial
  Synthetic
gacatccagatgacccagtctccatcctccctgtctgcatctgtaggagacagagtcaccatcacttgccgggcaagtgagaacatttacagctatttagcatggtatcagcagaaacaggggaaagcccctaagctcctggtctataatgcagaaaccttgacagaaggggtcccatcaaggttcagcggcagtggatctgggacagatttcactctcaccatcagcagtctgcaacctgaagattttgcaaattactactgtcaacatcattacggtaccccgctcacattcggccaagggaccaagctggatatcaaa

SEQ ID NO: 17 - protein, 107 aa, Artificial
  Synthetic
DIQMTQSPSSLSASVGDRVTITCRASENIYSYLAWYQQKPGKAPKLLVYNAETLTEGVPSRFSGSGSGTDFTLTISSLQPEDFANYYCQHHYGTPLTFGQGTKLEIK

SEQ ID NO: 18 - DNA, 321 bp, Artificial
  Synthetic
gacatccagatgacccagtctccatcctccctgtctgcatctgtaggagacagagtcaccatcacttgccgggcaagtgagaacatttacagctatttagcatggtatcagcagaaaccagggaaagcccctaagctcctggtctataatgcagaaaccttgacagaaggggtcccatcaaggttcagcggcagtggatctgggacagatttcactctcaccatcagcagtctgcaacctgaagattttgcaaattactactgtcaacatcattacggtaccccgctcacattcggccaagggaccaagctggaaatcaaa

SEQ ID NO: 19 - protein, 107 aa, Artificial
  Synthetic
DIQMTQSPSSLSASVGDRVTITCRASENIYSYLAWYQQKPGKAPKLLVYNAETLTEGVPSRFSGSGSGTDFTLTISSLQPEDFATYYCQHHYGTPLTFGQGTKLEIK

SEQ ID NO: 20 - DNA, 321 bp, Artificial
  Synthetic
gacatccagatgacccagtctccatcctccctgtctgcatctgtaggagacagagtcaccatcacttgccgggcaagtgagaacatttacagctatttagcatggtatcagcagaaaccagggaaagcccctaagctcctggtctataatgcagaaaccttgacagaaggggtcccatcaaggttcagcggcagtggatctgggacagatttcactctcaccatcagcagtctgcaacctgaagattttgcaacttactactgtcaacatcattacggtaccccgctcacattcggccaagggaccaagctggaaatcaaa

SEQ ID NO: 21 - protein, 107 aa, Artificial
  Synthetic
DIQMTQSPSSLSASVGDRVTITCRASENIYSYLNWYQQKPGKAPKLLVYNAETLTEGVPSRFSGSGSGTDFTLTISSLQPEDFATYYCQHHYGTPLTFGQGTKLEIK

SEQ ID NO: 22 - DNA, 321 bp, Artificial
  Synthetic
gacatccagatgacccagtctccatcctccctgtctgcatctgtaggagacagagtcaccatcacttgccgggcaagtgagaacatttacagctatttaaattggtatcagcagaaaccagggaaagcccctaagctcctggtctataatgcagaaaccttgacagaaggggtcccatcaaggttcagcggcagtggatctgggacagatttcactctcaccatcagcagtctgcaacctgaagattttgcaacttactactgtcaacatcattacggtaccccgctcacattcggccaagggaccaagctggaaatcaaa

SEQ ID NO: 23 - protein, 5 aa, Artificial
  Synthetic
SYSMS

SEQ ID NO: 24 - protein, 17 aa, Artificial
  Synthetic
YISYDGGSAYYPDTVKG

SEQ ID NO: 25 - protein, 12 aa, Artificial
  Synthetic
HGDYDDDDAMDY

SEQ ID NO: 26 - protein, 11 aa, Artificial
  Synthetic
RASENIYSYLA

SEQ ID NO: 27 - protein, 7 aa, Artificial
  Synthetic
NAETLTE

SEQ ID NO: 28 - protein, 9 aa, Artificial
  Synthetic
QHHYGTPLT

SEQ ID NO: 29 - protein, 451 aa, Artificial
  Synthetic
EVKLVESGGGLVQPGGSLKLFCAASGFTFTSYSMSWVRQTPEKRLEWVAYISYDGGSAYYPDTVKGRFSISRDNAKKTLYLQMSSLKSEDTAMYYCARHGDYDDDDAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - DNA, 1356 bp, Artificial
  Synthetic
gaggtgaagctggtggagtctgggggaggcttggtacagcctggggggtccctgaaactcttctgtgcagcctctggattcacctttaccagctattccatgagctgggtccgccagactccagagaagaggctggagtgggtcgcatacattagttatgatggtggtagcgcctactaccctgacactgtgaagggccggttctccatctccagagacaatgccaagaaaaccctgtatctgcaaatgagcagcctgaagtctgaggacacggccatgtattactgtgcaagacatggagactatgacgacgacgacgcgatggactactggggccaaggaacctcagtcaccgtctcctcagcctccaccaaaggccccagcgtcttccccctcgcgccgtcctccaagtccacctcgggtggcaccgccgccctgggctgcctggtcaaggactacttcccggagcctgtgaccgtgtcctggaactcgggcgcgctcacgagcggcgtacacaccttcccggcggtgctccagtcctccgggctgtactcgctctcgtcggtcgtcacggtgccgtcctcctccctgggcacccagacctacatctgcaacgtgaaccacaagccgtccaacaccaaggtggataagaaggtcgagcccaagtcgtgcgacaagacgcacacgtgcccgccgtgcccggccccggagctgctgggcggcccctcggtcttcctgttccccccgaagcccaaggatacgctgatgatctcccgcaccccggaggtcacctgcgtggtggtggacgtctcccacgaggacccggaggtgaaattcaactggtacgtcgacggagtggaggtccacaacgccaagaccaagccccgggaggagcagtacaactccacgtaccgcgtcgtctccgtcctgaccgtcctccaccaggactggctgaacggcaaggagtacaagtgtaaggtctccaacaaggcgctgcccgcccccatcgagaagaccatctccaaggcaaagggtcagccgcgggagccgcaggtctataccctccccccgtcccgcgacgagctgacgaaaaaccaggtctccctgacctgcctggtgaagggtttctacccctccgacatcgcggtcgagtgggagtcgaacggccagccggagaacaactacaagaccaccccccccgtgctcgacagtgacggctcgttcttcctgtactcgaagctgaccgtcgacaagtcgcgctggcagcagggcaacgtcttctcgtgctccgttatgcacgaggccctgcacaaccactacacgcagaagagtctttcgctgtccccggggaagtga

SEQ ID NO: 31 - protein, 451 aa, Artificial
  Synthetic
EVKLVESGGGLVQPGGSLRLSCAASGFTFTSYSMSWVRQAPGKGLEWVAYISYDGGSAYYPDTVKGRFTISRDNSKKTLYLQMSSLKSEDTAMYYCARHGDYDDDDAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - DNA, 1356 bp, Artificial
  Synthetic
gaggtgaagctggtggagtctgggggaggcttggtacagcctggggggtccctgagactctcctgtgcagcctctggattcacctttaccagctattccatgagctgggtccgccaggctccagggaaggggctggagtgggtcgcatacattagttatgatggtggtagcgcctactaccctgacactgtgaagggccggttcaccatctccagagacaattccaagaaaaccctgtatctgcaaatgagcagcctgaagtctgaggacacggccatgtattactgtgcaagacatggagactatgacgacgacgacgcgatggactactggggccaaggaacctcagtcaccgtctcctcagcctccaccaaaggccccagcgtcttccccctcgcgccgtcctccaagtccacctcgggtggcaccgccgccctgggctgcctggtcaaggactacttcccggagcctgtgaccgtgtcctggaactcgggcgcgctcacgagcggcgtacacaccttcccggcggtgctccagtcctccgggctgtactcgctctcgtcggtcgtcacggtgccgtcctcctccctgggcacccagacctacatctgcaacgtgaaccacaagccgtccaacaccaaggtggataagaaggtcgagcccaagtcgtgcgacaagacgcacacgtgcccgccgtgcccggccccggagctgctgggcggcccctcggtcttcctgttccccccgaagcccaaggatacgctgatgatctcccgcaccccggaggtcacctgcgtggtggtggacgtctcccacgaggacccggaggtgaaattcaactggtacgtcgacggagtggaggtccacaacgccaagaccaagccccgggaggagcagtacaactccacgtaccgcgtcgtctccgtcctgaccgtcctccaccaggactggctgaacggcaaggagtacaagtgtaaggtctccaacaaggcgctgcccgcccccatcgagaagaccatctccaaggcaaagggtcagccgcgggagccgcaggtctataccctccccccgtcccgcgacgagctgacgaaaaaccaggtctccctgacctgcctggtgaagggtttctacccctccgacatcgcggtcgagtgggagtcgaacggccagccggagaacaactacaagaccaccccccccgtgctcgacagtgacggctcgttcttcctgtactcgaagctgaccgtcgacaagtcgcgctggcagcagggcaacgtcttctcgtgctccgttatgcacgaggccctgcacaaccactacacgcagaagagtctttcgctgtccccggggaagtga

SEQ ID NO: 33 - protein, 451 aa, Artificial
  Synthetic
EVQLVESGGGLVQPGGSLRLSCAASGFTFTSYSMSWVRQAPGKGLEWVAYISYDGGSAYYPDTVKGRFTISRDNSKNTLYLQMSSLKSEDTAMYYCARHGDYDDDDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - DNA, 1356 bp, Artificial
  Synthetic
gaggtgcagctggtggagtctgggggaggcttggtacagcctggggggtccctgagactctcctgtgcagcctctggattcacctttaccagctattccatgagctgggtccgccaggctccagggaaggggctggagtgggtcgcatacattagttatgatggtggtagcgcctactaccctgacactgtgaagggccggttcaccatctccagagacaattccaagaacaccctgtatctgcaaatgagcagcctgaagtctgaggacacggccatgtattactgtgcaagacatggagactatgacgacgacgacgcgatggactactggggccaaggaaccctggtcaccgtctcctcagcctccaccaaaggccccagcgtcttccccctcgcgccgtcctccaagtccacctcgggtggcaccgccgccctgggctgcctggtcaaggactacttcccggagcctgtgaccgtgtcctggaactcgggcgcgctcacgagcggcgtacacaccttcccggcggtgctccagtcctccgggctgtactcgctctcgtcggtcgtcacggtgccgtcctcctccctgggcacccagacctacatctgcaacgtgaaccacaagccgtccaacaccaaggtggataagaaggtcgagcccaagtcgtgcgacaagacgcacacgtgcccgccgtgcccggccccggagctgctgggcggcccctcggtcttcctgttccccccgaagcccaaggatacgctgatgatctcccgcaccccggaggtcacctgcgtggtggtggacgtctcccacgaggacccggaggtgaaattcaactggtacgtcgacggagtggaggtccacaacgccaagaccaagccccgggaggagcagtacaactccacgtaccgcgtcgtctccgtcctgaccgtcctccaccaggactggctgaacggcaaggagtacaagtgtaaggtctccaacaaggcgctgcccgcccccatcgagaagaccatctccaaggcaaagggtcagccgcgggagccgcaggtctataccctccccccgtcccgcgacgagctgacgaaaaaccaggtctccctgacctgcctggtgaagggtttctacccctccgacatcgcggtcgagtgggagtcgaacggccagccggagaacaactacaagaccaccccccccgtgctcgacagtgacggctcgttcttcctgtactcgaagctgaccgtcgacaagtcgcgctggcagcagggcaacgtcttctcgtgctccgttatgcacgaggccctgcacaaccactacacgcagaagagtctttcgctgtccccggggaagtga

SEQ ID NO: 35 - protein, 451 aa, Artificial
  Synthetic
EVKLVESGGGLVQPGGSLRLSCAASGFTFTSYSMSWVRQAPGKGLEWVAYISYDGGSAYYPDTVKGRFTISRDNSKKTLYLQMNSLRAEDTAVYYCARHGDYDDDDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - DNA, 1356 bp, Artificial
  Synthetic
gaggtgaagctggtggagtctgggggaggcttggtacagcctggggggtccctgagactctcctgtgcagcctctggattcacctttaccagctattccatgagctgggtccgccaggctccagggaaggggctggagtgggtcgcatacattagttatgatggtggtagcgcctactatcctgacactgtgaagggccggttcaccatctccagagacaattccaagaaaaccctgtatctgcaaatgaacagcctgagagccgaggacacggccgtatattactgtgcaagacatggagactatgacgacgacgacgcgatggactactggggccaaggaaccctggtcaccgtctcctcagcctccaccaaaggccccagcgtcttccccctcgcgccgtcctccaagtccacctcgggtggcaccgccgccctgggctgcctggtcaaggactacttcccggagcctgtgaccgtgtcctggaactcgggcgcgctcacgagcggcgtacacaccttcccggcggtgctccagtcctccgggctgtactcgctctcgtcggtcgtcacggtgccgtcctcctccctgggcacccagacctacatctgcaacgtgaaccacaagccgtccaacaccaaggtggataagaaggtcgagcccaagtcgtgcgacaagacgcacacgtgcccgccgtgcccggccccggagctgctgggcggcccctcggtcttcctgttccccccgaagcccaaggatacgctgatgatctcccgcaccccggaggtcacctgcgtggtggtggacgtctcccacgaggacccggaggtgaaattcaactggtacgtcgacggagtggaggtccacaacgccaagaccaagccccgggaggagcagtacaactccacgtaccgcgtcgtctccgtcctgaccgtcctccaccaggactggctgaacggcaaggagtacaagtgtaaggtctccaacaaggcgctgcccgcccccatcgagaagaccatctccaaggcaaagggtcagccgcgggagccgcaggtctataccctccccccgtcccgcgacgagctgacgaaaaaccaggtctccctgacctgcctggtgaagggtttctacccctccgacatcgcggtcgagtgggagtcgaacggccagccggagaacaactacaagaccaccccccccgtgctcgacagtgacggctcgttcttcctgtactcgaagctgaccgtcgacaagtcgcgctggcagcagggcaacgtcttctcgtgctccgttatgcacgaggccctgcacaaccactacacgcagaagagtctttcgctgtccccggggaagtga

SEQ ID NO: 37 - protein, 451 aa, Artificial
  Synthetic
EVQLVESGGGLVQPGGSLRLSCAASGFTFTSYSMSWVRQAPGKGLEWVAYISYDGGSAYYPDTVKGRFTISRDNSKNTLYLQMNSLRAEDTAVYYCARHGDYDDDDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 38 - DNA, 1356 bp, Artificial
  Synthetic
gaggtgcagctggtggagtctgggggaggcttggtacagcctggggggtccctgagactctcctgtgcagcctctggattcacctttaccagctattccatgagctgggtccgccaggctccagggaaggggctggagtgggtcgcatacattagttatgatggtggtagcgcctactatcctgacactgtgaagggccggttcaccatctccagagacaattccaagaacaccctgtatctgcaaatgaacagcctgagagccgaggacacggccgtatattactgtgcaagacatggagactatgacgacgacgacgcgatggactactggggccaaggaaccctggtcaccgtctcctcagcctccaccaaaggccccagcgtcttccccctcgcgccgtcctccaagtccacctcgggtggcaccgccgccctgggctgcctggtcaaggactacttcccggagcctgtgaccgtgtcctggaactcgggcgcgctcacgagcggcgtacacaccttcccggcggtgctccagtcctccgggctgtactcgctctcgtcggtcgtcacggtgccgtcctcctccctgggcacccagacctacatctgcaacgtgaaccacaagccgtccaacaccaaggtggataagaaggtcgagcccaagtcgtgcgacaagacgcacacgtgcccgccgtgcccggccccggagctgctgggcggcccctcggtcttcctgttccccccgaagcccaaggatacgctgatgatctcccgcaccccggaggtcacctgcgtggtggtggacgtctcccacgaggacccggaggtgaaattcaactggtacgtcgacggagtggaggtccacaacgccaagaccaagccccgggaggagcagtacaactccacgtaccgcgtcgtctccgtcctgaccgtcctccaccaggactggctgaacggcaaggagtacaagtgtaaggtctccaacaaggcgctgcccgcccccatcgagaagaccatctccaaggcaaagggtcagccgcgggagccgcaggtctataccctccccccgtcccgcgacgagctgacgaaaaaccaggtctccctgacctgcctggtgaagggtttctacccctccgacatcgcggtcgagtgggagtcgaacggccagccggagaacaactacaagaccaccccccccgtgctcgacagtgacggctcgttcttcctgtactcgaagctgaccgtcgacaagtcgcgctggcagcagggcaacgtcttctcgtgctccgttatgcacgaggccctgcacaaccactacacgcagaagagtctttcgctgtccccggggaagtga

SEQ ID NO: 39 - protein, 451 aa, Artificial
  Synthetic
EVQLVESGGGLVQPGGSLRLSCAASGFTFTSYSMSWVRQAPGKGLEWVSYISYDGGSAYYPDTVKGRFTISRDNSKNTLYLQMNSLRAEDTAVYYCARHGDYDDDDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - DNA, 1356 bp, Artificial
  Synthetic
gaggtgcagctggtggagtctgggggaggcttggtacagcctggggggtccctgagactctcctgtgcagcctctggattcacctttaccagctattccatgagctgggtccgccaggctccagggaaggggctggagtgggtgtcttacattagttatgatggtggtagcgcctactatcctgacactgtgaagggccggttcaccatctccagagacaattccaagaacaccctgtatctgcaaatgaacagcctgagagccgaggacacggccgtatattactgtgcaagacatggagactatgacgacgacgacgcgatggactactggggccaaggaaccctggtcaccgtctcctcagcctccaccaaaggccccagcgtcttccccctcgcgccgtcctccaagtccacctcgggtggcaccgccgccctgggctgcctggtcaaggactacttcccggagcctgtgaccgtgtcctggaactcgggcgcgctcacgagcggcgtacacaccttcccggcggtgctccagtcctccgggctgtactcgctctcgtcggtcgtcacggtgccgtcctcctccctgggcacccagacctacatctgcaacgtgaaccacaagccgtccaacaccaaggtggataagaaggtcgagcccaagtcgtgcgacaagacgcacacgtgcccgccgtgcccggccccggagctgctgggcggcccctcggtcttcctgttccccccgaagcccaaggatacgctgatgatctcccgcaccccggaggtcacctgcgtggtggtggacgtctcccacgaggacccggaggtgaaattcaactggtacgtcgacggagtggaggtccacaacgccaagaccaagccccgggaggagcagtacaactccacgtaccgcgtcgtctccgtcctgaccgtcctccaccaggactggctgaacggcaaggagtacaagtgtaaggtctccaacaaggcgctgcccgcccccatcgagaagaccatctccaaggcaaagggtcagccgcgggagccgcaggtctataccctccccccgtcccgcgacgagctgacgaaaaaccaggtctccctgacctgcctggtgaagggtttctacccctccgacatcgcggtcgagtgggagtcgaacggccagccggagaacaactacaagaccaccccccccgtgctcgacagtgacggctcgttcttcctgtactcgaagctgaccgtcgacaagtcgcgctggcagcagggcaacgtcttctcgtgctccgttatgcacgaggccctgcacaaccactacacgcagaagagtctttcgctgtccccggggaagtga

SEQ ID NO: 41 - protein, 214 aa, Artificial
  Synthetic
DIQMTQSPASLSASVGETVTITCRASENIYSYLAWYQQKQGKSPQLLVYNAETLTEGVPSRFSGSGSGTQFSLKINSLQPEDFGNYYCQHHYGTPLTFGAGTKLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42 - DNA, 645 bp, Artificial
  Synthetic
gacatccagatgacccagtctccagcctccctgtctgcatctgtaggagaaactgtcaccatcacttgccgggcaagtgagaacatttacagctatttagcatggtatcagcagaaacaggggaaatctcctcagctcctggtctataatgcagaaaccttgacagaaggggtcccatcaaggttcagcggcagtggatctgggacacaattctctctcaagatcaacagtctgcaacctgaagattttgggaattactactgtcaacatcattacggtaccccgctcacattcggcgctgggaccaagctggatctgaaacgaacggtggccgcgccgagcgtcttcatcttcccgccttccgacgagcagctcaagtccgggaccgcctccgtagtatgcctcctcaataacttctacccccgggaggcgaaggtccagtggaaggtcgacaacgccctccaatcgggcaactcccaggagtcggtgaccgagcaggattccaaggactcgacctacagtctaagctccaccctcacactgtcgaaggcggactacgagaagcacaaggtgtacgcctgcgaggtcacccaccagggcctgagcagcccggtcaccaagtccttcaaccggggcgagtgctga

SEQ ID NO: 43 - protein, 214 aa, Artificial
  Synthetic
DIQMTQSPSSLSASVGDRVTITCRASENIYSYLAWYQQKQGKAPKLLVYNAETLTEGVPSRFSGSGSGTDFTLTISSLQPEDFANYYCQHHYGTPLTFGQGTKLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 44 - DNA, 645 bp, Artificial
  Synthetic
gacatccagatgacccagtctccatcctccctgtctgcatctgtaggagacagagtcaccatcacttgccgggcaagtgagaacatttacagctatttagcatggtatcagcagaaacaggggaaagcccctaagctcctggtctataatgcagaaaccttgacagaaggggtcccatcaaggttcagcggcagtggatctgggacagatttcactctcaccatcagcagtctgcaacctgaagattttgcaaattactactgtcaacatcattacggtaccccgctcacattcggccaagggaccaagctggatatcaaacgaacggtggccgcgccgagcgtcttcatcttcccgccttccgacgagcagctcaagtccgggaccgcctccgtagtatgcctcctcaataacttctacccccgggaggcgaaggtccagtggaaggtcgacaacgccctccaatcgggcaactcccaggagtcggtgaccgagcaggattccaaggactcgacctacagtctaagctccaccctcacactgtcgaaggcggactacgagaagcacaaggtgtacgcctgcgaggtcacccaccagggcctgagcagcccggtcaccaagtccttcaaccggggcgagtgctga

SEQ ID NO: 45 - protein, 214 aa, Artificial
  Synthetic
DIQMTQSPSSLSASVGDRVTITCRASENIYSYLAWYQQKPGKAPKLLVYNAETLTEGVPSRFSGSGSGTDFTLTISSLQPEDFANYYCQHHYGTPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 46 - DNA, 645 bp, Artificial
  Synthetic
gacatccagatgacccagtctccatcctccctgtctgcatctgtaggagacagagtcaccatcacttgccgggcaagtgagaacatttacagctatttagcatggtatcagcagaaaccagggaaagcccctaagctcctggtctataatgcagaaaccttgacagaaggggtcccatcaaggttcagcggcagtggatctgggacagatttcactctcaccatcagcagtctgcaacctgaagattttgcaaattactactgtcaacatcattacggtaccccgctcacattcggccaagggaccaagctggaaatcaaacgaacggtggccgcgccgagcgtcttcatcttcccgccttccgacgagcagctcaagtccgggaccgcctccgtagtatgcctcctcaataacttctacccccgggaggcgaaggtccagtggaaggtcgacaacgccctccaatcgggcaactcccaggagtcggtgaccgagcaggattccaaggactcgacctacagtctaagctccaccctcacactgtcgaaggcggactacgagaagcacaaggtgtacgcctgcgaggtcacccaccagggcctgagcagcccggtcaccaagtccttcaaccggggcgagtgctga

SEQ ID NO: 47 - protein, 214 aa, Artificial
  Synthetic
DIQMTQSPSSLSASVGDRVTITCRASENIYSYLAWYQQKPGKAPKLLVYNAETLTEGVPSRFSGSGSGTDFTLTISSLQPEDFATYYCQHHYGTPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 48 - DNA, 645 bp, Artificial
  Synthetic
gacatccagatgacccagtctccatcctccctgtctgcatctgtaggagacagagtcaccatcacttgccgggcaagtgagaacatttacagctatttagcatggtatcagcagaaaccagggaaagcccctaagctcctggtctataatgcagaaaccttgacagaaggggtcccatcaaggttcagcggcagtggatctgggacagatttcactctcaccatcagcagtctgcaacctgaagattttgcaacttactactgtcaacatcattacggtaccccgctcacattcggccaagggaccaagctggaaatcaaacgaacggtggccgcgccgagcgtcttcatcttcccgccttccgacgagcagctcaagtccgggaccgcctccgtagtatgcctcctcaataacttctacccccgggaggcgaaggtccagtggaaggtcgacaacgccctccaatcgggcaactcccaggagtcggtgaccgagcaggattccaaggactcgacctacagtctaagctccaccctcacactgtcgaaggcggactacgagaagcacaaggtgtacgcctgcgaggtcacccaccagggcctgagcagcccggtcaccaagtccttcaaccggggcgagtgctga

SEQ ID NO: 49 - protein, 214 aa, Artificial
  Synthetic
DIQMTQSPSSLSASVGDRVTITCRASENIYSYLNWYQQKPGKAPKLLVYNAETLTEGVPSRFSGSGSGTDFTLTISSLQPEDFATYYCQHHYGTPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 50 - DNA, 645 bp, Artificial
  Synthetic
gacatccagatgacccagtctccatcctccctgtctgcatctgtaggagacagagtcaccatcacttgccgggcaagtgagaacatttacagctatttaaattggtatcagcagaaaccagggaaagcccctaagctcctggtctataatgcagaaaccttgacagaaggggtcccatcaaggttcagcggcagtggatctgggacagatttcactctcaccatcagcagtctgcaacctgaagattttgcaacttactactgtcaacatcattacggtaccccgctcacattcggccaagggaccaagctggaaatcaaacgaacggtggccgcgccgagcgtcttcatcttcccgccttccgacgagcagctcaagtccgggaccgcctccgtagtatgcctcctcaataacttctacccccgggaggcgaaggtccagtggaaggtcgacaacgccctccaatcgggcaactcccaggagtcggtgaccgagcaggattccaaggactcgacctacagtctaagctccaccctcacactgtcgaaggcggactacgagaagcacaaggtgtacgcctgcgaggtcacccaccagggcctgagcagcccggtcaccaagtccttcaaccggggcgagtgctga

SEQ ID NO: 51 - protein, 8 aa, Artificial
  Synthetic
GFTFSSYS

SEQ ID NO: 52 - protein, 8 aa, Artificial
  Synthetic
ISSSSSYI

SEQ ID NO: 53 - protein, 19 aa, Artificial
  Synthetic
ARDGGRTSYTATAHNWFDP

SEQ ID NO: 54 - protein, 9 aa, Artificial
  Synthetic
FTFSSYSMN

SEQ ID NO: 55 - protein, 17 aa, Artificial
  Synthetic
SISSSSSYIYYADSVKG

SEQ ID NO: 56 - protein, 19 aa, Artificial
  Synthetic
ARDGGRTSYTATAHNWFDP

SEQ ID NO: 57 - protein, 126 aa, Artificial
  Synthetic
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDGGRTSYTATAHNWFDPWGQGTLVTVSS

SEQ ID NO: 58 - DNA, 378 bp, Artificial
  Synthetic
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctca

SEQ ID NO: 59 - protein, 12 aa, Artificial
  Synthetic
QSVLFSSNNKNY

SEQ ID NO: 60 - protein, 3 aa, Artificial
  Synthetic
WAS

SEQ ID NO: 61 - protein, 9 aa, Artificial
  Synthetic
QQHASAPPT

SEQ ID NO: 62 - protein, 17 aa, Artificial
  Synthetic
KSSQSVLFSSNNKNYLA

SEQ ID NO: 63 - protein, 7 aa, Artificial
  Synthetic
WASTRES

SEQ ID NO: 64 - protein, 9 aa, Artificial
  Synthetic
QQHASAPPT

SEQ ID NO: 65 - protein, 113 aa, Artificial
  Synthetic
DIVMTQSPDSLAVSLGERATINCKSSQSVLFSSNNKNYLAWYQQKPGQPPKLLIYWASTRESGVPDRFSGSGSGTDFTLTISSLQAEDVAVYYCQQHASAPPTFGGGTKVEIK

SEQ ID NO: 66 - DNA, 339 bp, Artificial
  Synthetic
gacatcgtgatgacccagtctccagactccctggctgtgtctctgggcgagagggccaccatcaactgcaagtccagccagagtgttttattcagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagcacgccagtgcccctcctacttttggcggagggaccaaggttgagatcaaa

SEQ ID NO: 67 - protein, 456 aa, Artificial
  Synthetic
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDGGRTSYTATAHNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - DNA, 1368 bp, Artificial
  Synthetic
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 69 - protein, 220 aa, Artificial
  Synthetic
DIVMTQSPDSLAVSLGERATINCKSSQSVLFSSNNKNYLAWYQQKPGQPPKLLIYWASTRESGVPDRFSGSGSGTDFTLTISSLQAEDVAVYYCQQHASAPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 70 - DNA, 660 bp, Artificial
  Synthetic
gacatcgtgatgacccagtctccagactccctggctgtgtctctgggcgagagggccaccatcaactgcaagtccagccagagtgttttattcagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagcacgccagtgcccctcctacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 71 - protein, 452 aa, Artificial
  Synthetic
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDGGRTSYTATAHNWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 72 - DNA, 1356 bp, Artificial
  Synthetic
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 73 - protein, 8 aa, Artificial
  Synthetic
GFTFRSYG

SEQ ID NO: 74 - protein, 8 aa, Artificial
  Synthetic
ISSSSSYI

SEQ ID NO: 75 - protein, 19 aa, Artificial
  Synthetic
ARDGGRTSYTATAHNWFDP

SEQ ID NO: 76 - protein, 9 aa, Artificial
  Synthetic
FTFRSYGMN

SEQ ID NO: 77 - protein, 17 aa, Artificial
  Synthetic
SISSSSSYIYYADSVKG

SEQ ID NO: 78 - protein, 19 aa, Artificial
  Synthetic
ARDGGRTSYTATAHNWFDP

SEQ ID NO: 79 - protein, 126 aa, Artificial
  Synthetic
EVQLVESGGGLVKPGGSLRLSCAASGFTFRSYGMNWVRQAPGKGLEWVSSISSSSSYIYYADSVKGRFTISRDNAKNSLYLQMNSLRAEDTAVYYCARDGGRTSYTATAHNWFDPWGQGTLVTVSS

SEQ ID NO: 80 - DNA, 378 bp, Artificial
  Synthetic
gaggtgcagctggtggagtctgggggaggcctggtcaagcctggggggtccctgagactctcctgtgcagcctctggattcaccttccggagctatgggatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctca

SEQ ID NO: 81 - protein, 12 aa, Artificial
  Synthetic
QSVLFSSNNKNY

SEQ ID NO: 82 - protein, 3 aa, Artificial
  Synthetic
WAS

SEQ ID NO: 83 - protein, 9 aa, Artificial
  Synthetic
QQHASAPPT

SEQ ID NO: 84 - protein, 17 aa, Artificial
  Synthetic
KSSQSVLFSSNNKNYLA

SEQ ID NO: 85 - protein, 7 aa, Artificial
  Synthetic
WASTRES

SEQ ID NO: 86 - protein, 9 aa, Artificial
  Synthetic
QQHASAPPT

SEQ ID NO: 87 - protein, 113 aa, Artificial; identical to SEQ ID NO: 65
  Synthetic

SEQ ID NO: 88 - DNA, 339 bp, Artificial; identical to SEQ ID NO: 66
  Synthetic

SEQ ID NO: 89 - protein, 456 aa, Artificial
  Synthetic
EVQLVESGGGLVKPGGSLRLSCAASGFTFRSYGMNWVRQAPGKGLEWVSSISSSSSYIYYADSVKGRFTISRDNAKNSLYLQMNSLRAEDTAVYYCARDGGRTSYTATAHNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - DNA, 1368 bp, Artificial
  Synthetic
gaggtgcagctggtggagtctgggggaggcctggtcaagcctggggggtccctgagactctcctgtgcagcctctggattcaccttccggagctatgggatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 91 - protein, 220 aa, Artificial; identical to SEQ ID NO: 69
  Synthetic

SEQ ID NO: 92 - DNA, 660 bp, Artificial; identical to SEQ ID NO: 70
  Synthetic

SEQ ID NO: 93 - protein, 452 aa, Artificial
  Synthetic
EVQLVESGGGLVKPGGSLRLSCAASGFTFRSYGMNWVRQAPGKGLEWVSSISSSSSYIYYADSVKGRFTISRDNAKNSLYLQMNSLRAEDTAVYYCARDGGRTSYTATAHNWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 94 - DNA, 1356 bp, Artificial
  Synthetic
gaggtgcagctggtggagtctgggggaggcctggtcaagcctggggggtccctgagactctcctgtgcagcctctggattcaccttccggagctatgggatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 95 - protein, 8 aa, Artificial
  Synthetic
GFTFSRTG

SEQ ID NO: 96 - protein, 8 aa, Artificial
  Synthetic
ISSSSSYI

SEQ ID NO: 97 - protein, 19 aa, Artificial
  Synthetic
ARDGGRTSYTATAHNWFDP

SEQ ID NO: 98 - protein, 9 aa, Artificial
  Synthetic
FTFSRTGMN

SEQ ID NO: 99 - protein, 17 aa, Artificial
  Synthetic
SISSSSSYIYYADSVKG

SEQ ID NO: 100 - protein, 19 aa, Artificial
  Synthetic
ARDGGRTSYTATAHNWFDP

SEQ ID NO: 101 - protein, 126 aa, Artificial
  Synthetic
EVQLVESGGGLVKPGGSLRLSCAASGFTFSRTGMNWVRQAPGKGLEWVSSISSSSSYIYYADSVKGRFTISRDNAKNSLYLQMNSLRAEDTAVYYCARDGGRTSYTATAHNWFDPWGQGTLVTVSS

SEQ ID NO: 102 - DNA, 378 bp, Artificial
  Synthetic
gaggtgcagctggtggagtctgggggaggcctggtcaagcctggggggtccctgagactctcctgtgcagcctctggattcaccttcagtaggactgggatgaactgggtccgccaggctccagggaaggggctggaatgggtctcatccattagtagtagtagtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctca

SEQ ID NO: 103 - protein, 12 aa, Artificial
  Synthetic
QSVLFSSNNKNY

SEQ ID NO: 104 - protein, 3 aa, Artificial
  Synthetic
WAS

SEQ ID NO: 105 - protein, 9 aa, Artificial
  Synthetic
QQHASAPPT

SEQ ID NO: 106 - protein, 17 aa, Artificial
  Synthetic
KSSQSVLFSSNNKNYLA

SEQ ID NO: 107 - protein, 7 aa, Artificial
  Synthetic
WASTRES

SEQ ID NO: 108 - protein, 9 aa, Artificial
  Synthetic
QQHASAPPT

SEQ ID NO: 109 - protein, 113 aa, Artificial; identical to SEQ ID NO: 65
  Synthetic

SEQ ID NO: 110 - DNA, 339 bp, Artificial; identical to SEQ ID NO: 66
  Synthetic

SEQ ID NO: 111 - protein, 456 aa, Artificial
  Synthetic
EVQLVESGGGLVKPGGSLRLSCAASGFTFSRTGMNWVRQAPGKGLEWVSSISSSSSYIYYADSVKGRFTISRDNAKNSLYLQMNSLRAEDTAVYYCARDGGRTSYTATAHNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - DNA, 1368 bp, Artificial
  Synthetic
gaggtgcagctggtggagtctgggggaggcctggtcaagcctggggggtccctgagactctcctgtgcagcctctggattcaccttcagtaggactgggatgaactgggtccgccaggctccagggaaggggctggaatgggtctcatccattagtagtagtagtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 113 - protein, 220 aa, Artificial; identical to SEQ ID NO: 69
  Synthetic

SEQ ID NO: 114 - DNA, 660 bp, Artificial; identical to SEQ ID NO: 70
  Synthetic

SEQ ID NO: 115 - protein, 452 aa, Artificial
  Synthetic
EVQLVESGGGLVKPGGSLRLSCAASGFTFSRTGMNWVRQAPGKGLEWVSSISSSSSYIYYADSVKGRFTISRDNAKNSLYLQMNSLRAEDTAVYYCARDGGRTSYTATAHNWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 116 - DNA, 1356 bp, Artificial
  Synthetic
gaggtgcagctggtggagtctgggggaggcctggtcaagcctggggggtccctgagactctcctgtgcagcctctggattcaccttcagtaggactgggatgaactgggtccgccaggctccagggaaggggctggaatgggtctcatccattagtagtagtagtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 117 - protein, 8 aa, Artificial
  Synthetic
GFTFSRYG

SEQ ID NO: 118 - protein, 8 aa, Artificial
  Synthetic
ISSSSAYI

SEQ ID NO: 119 - protein, 19 aa, Artificial
  Synthetic
ARDGGRTSYTATAHNWFDP

SEQ ID NO: 120 - protein, 9 aa, Artificial
  Synthetic
FTFSRYGMN

SEQ ID NO: 121 - protein, 17 aa, Artificial
  Synthetic
SISSSSAYILYADSVKG

SEQ ID NO: 122 - protein, 19 aa, Artificial
  Synthetic
ARDGGRTSYTATAHNWFDP

SEQ ID NO: 123 - protein, 126 aa, Artificial
  Synthetic
EVQLVESGGGLVKPGGSLRLSCAASGFTFSRYGMNWVRQAPGKGLEWVSSISSSSAYILYADSVKGRFTISRDNAKNSLYLQMNSLRAEDTAVYYCARDGGRTSYTATAHNWFDPWGQGTLVTVSS

SEQ ID NO: 124 - DNA, 378 bp, Artificial
  Synthetic
gaggtgcagctggtggagtctgggggaggcctggtcaagcctggggggtccctgagactctcctgtgcagcctctggattcaccttcagtaggtatgggatgaactgggtccgccaggctccagggaaggggctggagtgggtctcatccattagtagtagtagtgcttacatactgtacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctca

SEQ ID NO: 125 - protein, 12 aa, Artificial
  Synthetic
QSVLFSSNNKNY

SEQ ID NO: 126 - protein, 3 aa, Artificial
  Synthetic
WAS

SEQ ID NO: 127 - protein, 9 aa, Artificial
  Synthetic
QQHASAPPT

SEQ ID NO: 128 - protein, 17 aa, Artificial
  Synthetic
KSSQSVLFSSNNKNYLA

SEQ ID NO: 129 - protein, 7 aa, Artificial
  Synthetic
WASTRES

SEQ ID NO: 130 - protein, 9 aa, Artificial
  Synthetic
QQHASAPPT

SEQ ID NO: 131 - protein, 113 aa, Artificial; identical to SEQ ID NO: 65
  Synthetic

SEQ ID NO: 132 - DNA, 339 bp, Artificial; identical to SEQ ID NO: 66
  Synthetic

SEQ ID NO: 133 - protein, 456 aa, Artificial
  Synthetic
EVQLVESGGGLVKPGGSLRLSCAASGFTFSRYGMNWVRQAPGKGLEWVSSISSSSAYILYADSVKGRFTISRDNAKNSLYLQMNSLRAEDTAVYYCARDGGRTSYTATAHNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 134 - DNA, 1368 bp, Artificial
  Synthetic
gaggtgcagctggtggagtctgggggaggcctggtcaagcctggggggtccctgagactctcctgtgcagcctctggattcaccttcagtaggtatgggatgaactgggtccgccaggctccagggaaggggctggagtgggtctcatccattagtagtagtagtgcttacatactgtacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 135 - protein, 220 aa, Artificial; identical to SEQ ID NO: 69
  Synthetic

SEQ ID NO: 136 - DNA, 660 bp, Artificial; identical to SEQ ID NO: 70
  Synthetic

SEQ ID NO: 137 - protein, 452 aa, Artificial
  Synthetic
EVQLVESGGGLVKPGGSLRLSCAASGFTFSRYGMNWVRQAPGKGLEWVSSISSSSAYILYADSVKGRFTISRDNAKNSLYLQMNSLRAEDTAVYYCARDGGRTSYTATAHNWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 138 - DNA, 1356 bp, Artificial
  Synthetic
gaggtgcagctggtggagtctgggggaggcctggtcaagcctggggggtccctgagactctcctgtgcagcctctggattcaccttcagtaggtatgggatgaactgggtccgccaggctccagggaaggggctggagtgggtctcatccattagtagtagtagtgcttacatactgtacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 139 - protein, 8 aa, Artificial
  Synthetic
GFTFASYG

SEQ ID NO: 140 - protein, 8 aa, Artificial
  Synthetic
ISSSSSYI

SEQ ID NO: 141 - protein, 19 aa, Artificial
  Synthetic
ARDGGRTSYTATAHNWFDP

SEQ ID NO: 142 - protein, 9 aa, Artificial
  Synthetic
FTFASYGMN

SEQ ID NO: 143 - protein, 17 aa, Artificial
  Synthetic
SISSSSSYIYYADSVKG

SEQ ID NO: 144 - protein, 19 aa, Artificial
  Synthetic
ARDGGRTSYTATAHNWFDP

SEQ ID NO: 145 - protein, 126 aa, Artificial
  Synthetic
EVQLVESGGGLVKPGGSLRLSCAASGFTFASYGMNWVRQAPGKGLEWVSSISSSSSYIYYADSVKGRFTISRDNAKNSLYLQMNSLRAEDTAVYYCARDGGRTSYTATAHNWFDPWGQGTLVTVSS

SEQ ID NO: 146 - DNA, 378 bp, Artificial
  Synthetic
gaggtgcagctggtggagtctgggggaggcctggtcaagcctggggggtccctgagactctcctgtgcagcctctggattcaccttcgctagctatgggatgaactgggtccgccaggctccagggaaggggctggagtgggtctcatccattagtagttctagtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctca

SEQ ID NO: 147 - protein, 12 aa, Artificial
  Synthetic
QSVLFSSNNKNY

SEQ ID NO: 148 - protein, 3 aa, Artificial
  Synthetic
WAS

SEQ ID NO: 149 - protein, 9 aa, Artificial
  Synthetic
QQHASAPPT

SEQ ID NO: 150 - protein, 17 aa, Artificial
  Synthetic
KSSQSVLFSSNNKNYLA

SEQ ID NO: 151 - protein, 7 aa, Artificial
  Synthetic
WASTRES

SEQ ID NO: 152 - protein, 9 aa, Artificial
  Synthetic
QQHASAPPT

SEQ ID NO: 153 - protein, 113 aa, Artificial; identical to SEQ ID NO: 65
  Synthetic

SEQ ID NO: 154 - DNA, 339 bp, Artificial; identical to SEQ ID NO: 66
  Synthetic

SEQ ID NO: 155 - protein, 456 aa, Artificial
  Synthetic
EVQLVESGGGLVKPGGSLRLSCAASGFTFASYGMNWVRQAPGKGLEWVSSISSSSSYIYYADSVKGRFTISRDNAKNSLYLQMNSLRAEDTAVYYCARDGGRTSYTATAHNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 156 - DNA, 1368 bp, Artificial
  Synthetic
gaggtgcagctggtggagtctgggggaggcctggtcaagcctggggggtccctgagactctcctgtgcagcctctggattcaccttcgctagctatgggatgaactgggtccgccaggctccagggaaggggctggagtgggtctcatccattagtagttctagtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 157 - protein, 220 aa, Artificial; identical to SEQ ID NO: 69
  Synthetic

SEQ ID NO: 158 - DNA, 660 bp, Artificial; identical to SEQ ID NO: 70
  Synthetic

SEQ ID NO: 159 - protein, 452 aa, Artificial
  Synthetic
EVQLVESGGGLVKPGGSLRLSCAASGFTFASYGMNWVRQAPGKGLEWVSSISSSSSYIYYADSVKGRFTISRDNAKNSLYLQMNSLRAEDTAVYYCARDGGRTSYTATAHNWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 160 - DNA, 1356 bp, Artificial
  Synthetic
gaggtgcagctggtggagtctgggggaggcctggtcaagcctggggggtccctgagactctcctgtgcagcctctggattcaccttcgctagctatgggatgaactgggtccgccaggctccagggaaggggctggagtgggtctcatccattagtagttctagtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 161 - protein, 8 aa, Artificial
  Synthetic
GFTFRSYG

SEQ ID NO: 162 - protein, 8 aa, Artificial
  Synthetic
ISSSGSYI

SEQ ID NO: 163 - protein, 19 aa, Artificial
  Synthetic
ARDGGRTSYTATAHNWFDP

SEQ ID NO: 164 - protein, 9 aa, Artificial
  Synthetic
FTFRSYGMN

SEQ ID NO: 165 - protein, 17 aa, Artificial
  Synthetic
GISSSGSYIYYADSVKG

SEQ ID NO: 166 - protein, 19 aa, Artificial
  Synthetic
ARDGGRTSYTATAHNWFDP

SEQ ID NO: 167 - protein, 126 aa, Artificial
  Synthetic
EVQLVESGGGLVKPGGSLRLSCAASGFTFRSYGMNWVRQAPGKGLEWVSGISSSGSYIYYADSVKGRFTISRDNAKNSLYLQMNSLRAEDTAVYYCARDGGRTSYTATAHNWFDPWGQGTLVTVSS

SEQ ID NO: 168 - DNA, 378 bp, Artificial
  Synthetic
gaggtgcagctggtggagtctgggggaggcctggtcaagcctggggggtccctgagactctcctgtgcagcctctggattcaccttccgtagctatgggatgaactgggtccgccaggctccagggaaggggctggagtgggtctcaggtattagtagtagtggtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctca

SEQ ID NO: 169 - protein, 12 aa, Artificial
  Synthetic
QSVLFSSNNKNY

SEQ ID NO: 170 - protein, 3 aa, Artificial
  Synthetic
WAS

SEQ ID NO: 171 - protein, 9 aa, Artificial
  Synthetic
QQHASAPPT

SEQ ID NO: 172 - protein, 17 aa, Artificial
  Synthetic
KSSQSVLFSSNNKNYLA

SEQ ID NO: 173 - protein, 7 aa, Artificial
  Synthetic
WASTRES

SEQ ID NO: 174 - protein, 9 aa, Artificial
  Synthetic
QQHASAPPT

SEQ ID NO: 175 - protein, 113 aa, Artificial; identical to SEQ ID NO: 65
  Synthetic

SEQ ID NO: 176 - DNA, 339 bp, Artificial; identical to SEQ ID NO: 66
  Synthetic

SEQ ID NO: 177 - protein, 456 aa, Artificial
  Synthetic
EVQLVESGGGLVKPGGSLRLSCAASGFTFRSYGMNWVRQAPGKGLEWVSGISSSGSYIYYADSVKGRFTISRDNAKNSLYLQMNSLRAEDTAVYYCARDGGRTSYTATAHNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 178 - DNA, 1368 bp, Artificial
  Synthetic
gaggtgcagctggtggagtctgggggaggcctggtcaagcctggggggtccctgagactctcctgtgcagcctctggattcaccttccgtagctatgggatgaactgggtccgccaggctccagggaaggggctggagtgggtctcaggtattagtagtagtggtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 179 - protein, 220 aa, Artificial; identical to SEQ ID NO: 69
  Synthetic

SEQ ID NO: 180 - DNA, 660 bp, Artificial; identical to SEQ ID NO: 70
  Synthetic

SEQ ID NO: 181 - protein, 452 aa, Artificial
  Synthetic
EVQLVESGGGLVKPGGSLRLSCAASGFTFRSYGMNWVRQAPGKGLEWVSGISSSGSYIYYADSVKGRFTISRDNAKNSLYLQMNSLRAEDTAVYYCARDGGRTSYTATAHNWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 182 - DNA, 1356 bp, Artificial
  Synthetic
gaggtgcagctggtggagtctgggggaggcctggtcaagcctggggggtccctgagactctcctgtgcagcctctggattcaccttccgtagctatgggatgaactgggtccgccaggctccagggaaggggctggagtgggtctcaggtattagtagtagtggtagttacatatactacgcagactcagtgaagggccgattcaccatctccagagacaacgccaagaactcactgtatctgcaaatgaacagcctgagagccgaggacacggcggtgtactactgcgccagagatggtggaagaacgtcctacaccgccacagcccacaattggttcgacccctggggacagggtacattggtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 183 - protein, 451 aa, Artificial
  Synthetic
EVKLVESGGGLVQPGGSLKLFCAASGFTFTSYSMSWVRQTPEKRLEWVAYISYDGGSAYYPDTVKGRFSISRDNAKKTLYLQMSSLKSEDTAMYYCARHGDYDDDDAMDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 184 - protein, 213 aa, Artificial
  Synthetic
DIQMTQSPASLSASVGETVTITCRASENIYSYLAWYQQKQGKSPQLLVYNAETLTEGVPSRFSGSGSGTQFSLKINSLQPEDFGNYYCQHHYGTPLTFGAGTKLDLKADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 185 - protein, 8 aa, Artificial
  Synthetic
GGTFSAYA

SEQ ID NO: 186 - protein, 8 aa, Artificial
  Synthetic
IIPIFGTA

SEQ ID NO: 187 - protein, 17 aa, Artificial
  Synthetic
ARSYYSSRWHYYYYMDV

SEQ ID NO: 188 - protein, 9 aa, Artificial
  Synthetic
GTFSAYAIS

SEQ ID NO: 189 - protein, 17 aa, Artificial
  Synthetic
GIIPIFGTANYAQKFQG

SEQ ID NO: 190 - protein, 17 aa, Artificial
  Synthetic
ARSYYSSRWHYYYYMDV

SEQ ID NO: 191 - protein, 124 aa, Artificial
  Synthetic
QVQLVQSGAEVKKPGSSVKVSCKASGGTFSAYAISWVRQAPGQGLEWMGGIIPIFGTANYAQKFQGRVTITADESTSTAYMELSSLRSEDTAVYYCARSYYSSRWHYYYYMDVWGKGTTVTVSS

SEQ ID NO: 192 - DNA, 372 bp, Artificial
  Synthetic
caggtgcagctggtgcagtctggggctgaggtgaagaagcctgggtcctcggtgaaggtctcctgcaaggcttctggaggcaccttcagcgcttatgcgatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagatcttactactccagccgatggcactactactactacatggacgtgtggggcaagggtacaactgtcaccgtctcctca

SEQ ID NO: 193 - protein, 6 aa, Artificial
  Synthetic
QGISSW

SEQ ID NO: 194 - protein, 3 aa, Artificial
  Synthetic
AAS

SEQ ID NO: 195 - protein, 9 aa, Artificial
  Synthetic
QQADDLPLT

SEQ ID NO: 196 - protein, 11 aa, Artificial
  Synthetic
RASQGISSWLA

SEQ ID NO: 197 - protein, 7 aa, Artificial
  Synthetic
AASNLQS

SEQ ID NO: 198 - protein, 9 aa, Artificial
  Synthetic
QQADDLPLT

SEQ ID NO: 199 - protein, 107 aa, Artificial
  Synthetic
DIQMTQSPSSVSASVGDRVTITCRASQGISSWLAWYQQKPGKAPKLLIYAASNLQSGVPSRFSGSGSGTDFTLTISSLQPEDFATYYCQQADDLPLTFGGGTKVEIK

SEQ ID NO: 200 - DNA, 321 bp, Artificial
  Synthetic
gacatccagatgacacagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccaatttgcaaagtggggtcccatcaaggttcagcggcagtggatctgggacagatttcactctcaccatcagcagcctgcagcctgaagattttgcaacttattactgtcagcaggcagacgacctccctctcacttttggcggagggaccaaggttgagatcaaa

SEQ ID NO: 201 - protein, 454 aa, Artificial
  Synthetic
QVQLVQSGAEVKKPGSSVKVSCKASGGTFSAYAISWVRQAPGQGLEWMGGIIPIFGTANYAQKFQGRVTITADESTSTAYMELSSLRSEDTAVYYCARSYYSSRWHYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 202 - DNA, 1362 bp, Artificial
  Synthetic
caggtgcagctggtgcagtctggggctgaggtgaagaagcctgggtcctcggtgaaggtctcctgcaaggcttctggaggcaccttcagcgcttatgcgatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagatcttactactccagccgatggcactactactactacatggacgtgtggggcaagggtacaactgtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 203 - protein, 214 aa, Artificial
  Synthetic
DIQMTQSPSSVSASVGDRVTITCRASQGISSWLAWYQQKPGKAPKLLIYAASNLQSGVPSRFSGSGSGTDFTLTISSLQPEDFATYYCQQADDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204 - DNA, 642 bp, Artificial
  Synthetic
gacatccagatgacacagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccaatttgcaaagtggggtcccatcaaggttcagcggcagtggatctgggacagatttcactctcaccatcagcagcctgcagcctgaagattttgcaacttattactgtcagcaggcagacgacctccctctcacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 205 - protein, 450 aa, Artificial
  Synthetic
QVQLVQSGAEVKKPGSSVKVSCKASGGTFSAYAISWVRQAPGQGLEWMGGIIPIFGTANYAQKFQGRVTITADESTSTAYMELSSLRSEDTAVYYCARSYYSSRWHYYYYMDVWGKGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 206 - DNA, 1350 bp, Artificial
  Synthetic
caggtgcagctggtgcagtctggggctgaggtgaagaagcctgggtcctcggtgaaggtctcctgcaaggcttctggaggcaccttcagcgcttatgcgatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagatcttactactccagccgatggcactactactactacatggacgtgtggggcaagggtacaactgtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 207 - protein, 8 aa, Artificial
  Synthetic
GGTFESYT

SEQ ID NO: 208 - protein, 8 aa, Artificial
  Synthetic
IAPIFGTA

SEQ ID NO: 209 - protein, 17 aa, Artificial
  Synthetic
ARSYYSSRWHYYYYMDV

SEQ ID NO: 210 - protein, 9 aa, Artificial
  Synthetic
GTFESYTIS

SEQ ID NO: 211 - protein, 17 aa, Artificial
  Synthetic
GIAPIFGTAHYAQKFQG

SEQ ID NO: 212 - protein, 17 aa, Artificial
  Synthetic
ARSYYSSRWHYYYYMDV

SEQ ID NO: 213 - protein, 124 aa, Artificial
  Synthetic
QVQLVQSGAEVKKPGSSVKVSCKASGGTFESYTISWVRQAPGQGLEWMGGIAPIFGTAHYAQKFQGRVTITADESTSTAYMELSSLRSEDTAVYYCARSYYSSRWHYYYYMDVWGKGTTVTVSS

SEQ ID NO: 214 - DNA, 372 bp, Artificial
  Synthetic
caggtgcagctggtgcagtctggggctgaggtgaagaagcctgggtcctcggtgaaggtctcctgcaaggcttctggaggcaccttcgagagctatacgatcagctgggtgcgacaggcccctggacaagggcttgagtggatgggagggatcgcgcctatctttggtacagcacattacgcacagaagttccagggcagagtcacgattaccgcggacgaatccacgagcacagcctacatggagctgagcagcctgagatctgaggacacggcggtgtactactgcgccagatcttactactccagccgatggcactactactactacatggacgtgtggggcaagggtacaactgtcaccgtctcctca

SEQ ID NO: 215 - protein, 6 aa, Artificial
  Synthetic
QGISSW

SEQ ID NO: 216 - protein, 3 aa, Artificial
  Synthetic
AAS

SEQ ID NO: 217 - protein, 9 aa, Artificial
  Synthetic
QQADDLPLT

SEQ ID NO: 218 - protein, 11 aa, Artificial
  Synthetic
RASQGISSWLA

SEQ ID NO: 219 - protein, 7 aa, Artificial
  Synthetic
AASNLQS

SEQ ID NO: 220 - protein, 9 aa, Artificial
  Synthetic
QQADDLPLT

SEQ ID NO: 221 - protein, 107 aa, Artificial; identical to SEQ ID NO: 199
  Synthetic

SEQ ID NO: 222 - DNA, 321 bp, Artificial
  Synthetic
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccaatttgcaaagtggggtcccatcaaggttcagcggcagtggatctgggacagatttcactctcaccatcagcagcctgcagcctgaagattttgcaacttactattgtcagcaggcagacgacctccctctcacttttggcggagggaccaaggttgagatcaaa

SEQ ID NO: 223 - protein, 454 aa, Artificial
  Synthetic
QVQLVQSGAEVKKPGSSVKVSCKASGGTFESYTISWVRQAPGQGLEWMGGIAPIFGTAHYAQKFQGRVTITADESTSTAYMELSSLRSEDTAVYYCARSYYSSRWHYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 224 - DNA, 1362 bp, Artificial
  Synthetic
caggtgcagctggtgcagtctggggctgaggtgaagaagcctgggtcctcggtgaaggtctcctgcaaggcttctggaggcaccttcgagagctatacgatcagctgggtgcgacaggcccctggacaagggcttgagtggatgggagggatcgcgcctatctttggtacagcacattacgcacagaagttccagggcagagtcacgattaccgcggacgaatccacgagcacagcctacatggagctgagcagcctgagatctgaggacacggcggtgtactactgcgccagatcttactactccagccgatggcactactactactacatggacgtgtggggcaagggtacaactgtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 225 - protein, 214 aa, Artificial; identical to SEQ ID NO: 203
  Synthetic

SEQ ID NO: 226 - DNA, 642 bp, Artificial
  Synthetic
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccaatttgcaaagtggggtcccatcaaggttcagcggcagtggatctgggacagatttcactctcaccatcagcagcctgcagcctgaagattttgcaacttactattgtcagcaggcagacgacctccctctcacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 227 - protein, 450 aa, Artificial
  Synthetic
QVQLVQSGAEVKKPGSSVKVSCKASGGTFESYTISWVRQAPGQGLEWMGGIAPIFGTAHYAQKFQGRVTITADESTSTAYMELSSLRSEDTAVYYCARSYYSSRWHYYYYMDVWGKGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 228 - DNA, 1350 bp, Artificial
  Synthetic
caggtgcagctggtgcagtctggggctgaggtgaagaagcctgggtcctcggtgaaggtctcctgcaaggcttctggaggcaccttcgagagctatacgatcagctgggtgcgacaggcccctggacaagggcttgagtggatgggagggatcgcgcctatctttggtacagcacattacgcacagaagttccagggcagagtcacgattaccgcggacgaatccacgagcacagcctacatggagctgagcagcctgagatctgaggacacggcggtgtactactgcgccagatcttactactccagccgatggcactactactactacatggacgtgtggggcaagggtacaactgtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 229 - protein, 8 aa, Artificial
  Synthetic
GGSFSDYE

SEQ ID NO: 230 - protein, 7 aa, Artificial
  Synthetic
IDWSGIT

SEQ ID NO: 231 - protein, 19 aa, Artificial
  Synthetic
ARLPMYYYDSSVSTGSVDV

SEQ ID NO: 232 - protein, 9 aa, Artificial
  Synthetic
GSFSDYEWS

SEQ ID NO: 233 - protein, 16 aa, Artificial
  Synthetic
EIDWSGITNYNPSLKS

SEQ ID NO: 234 - protein, 19 aa, Artificial
  Synthetic
ARLPMYYYDSSVSTGSVDV

SEQ ID NO: 235 - protein, 125 aa, Artificial
  Synthetic
QVQLQQWGAGLLKPSETLSLTCAVYGGSFSDYEWSWIRQPPGKGLEWIGEIDWSGITNYNPSLKSRVTISVDTSKNQFSLKLSSVTAADTAVYYCARLPMYYYDSSVSTGSVDVWGQGTMVTVSS

SEQ ID NO: 236 - DNA, 375 bp, Artificial
  Synthetic
caagtacaattacaacagtggggagctggtttattaaagccttcagaaactttaagtttgacctgtgctgtttacggtggatcattttctgattatgagtggagttggattcgtcaaccaccaggcaaaggattggagtggatcggtgagatagactggtcaggcattactaactacaatccaagtttaaaatccagggttactatctccgtagacacgtccaagaaccagttctccctgaagctgagttctgtgaccgccgcagacacggcggtgtactactgcgccagacttcctatgtactactacgacagcagcgtctcaaccggaagcgtagacgtatggggtcagggtacaatggtcaccgtctcctca

SEQ ID NO: 237 - protein, 6 aa, Artificial
  Synthetic
QSVSSY

SEQ ID NO: 238 - protein, 3 aa, Artificial
  Synthetic
DSS

SEQ ID NO: 239 - protein, 9 aa, Artificial
  Synthetic
QQDSDHPIT

SEQ ID NO: 240 - protein, 11 aa, Artificial
  Synthetic
RASQSVSSYLA

SEQ ID NO: 241 - protein, 7 aa, Artificial
  Synthetic
DSSNRAT

SEQ ID NO: 242 - protein, 9 aa, Artificial
  Synthetic
QQDSDHPIT

SEQ ID NO: 243 - protein, 107 aa, Artificial
  Synthetic
EIVLTQSPATLSLSPGERATLSCRASQSVSSYLAWYQQKPGQAPRLLIYDSSNRATGIPARFSGSGSGTDFTLTISSLEPEDFAVYYCQQDSDHPITFGGGTKVEIK

SEQ ID NO: 244 - DNA, 321 bp, Artificial
  Synthetic
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgattcatccaacagggccactggcatcccagccaggttcagtggcagtgggtctgggacagacttcactctcaccatcagcagcctagagcctgaagattttgcagtttattactgtcagcaggacagtgaccaccctatcacttttggcggagggaccaaggttgagatcaaa

SEQ ID NO: 245 - protein, 455 aa, Artificial
  Synthetic
QVQLQQWGAGLLKPSETLSLTCAVYGGSFSDYEWSWIRQPPGKGLEWIGEIDWSGITNYNPSLKSRVTISVDTSKNQFSLKLSSVTAADTAVYYCARLPMYYYDSSVSTGSVDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 246 - DNA, 1365 bp, Artificial
  Synthetic
caagtacaattacaacagtggggagctggtttattaaagccttcagaaactttaagtttgacctgtgctgtttacggtggatcattttctgattatgagtggagttggattcgtcaaccaccaggcaaaggattggagtggatcggtgagatagactggtcaggcattactaactacaatccaagtttaaaatccagggttactatctccgtagacacgtccaagaaccagttctccctgaagctgagttctgtgaccgccgcagacacggcggtgtactactgcgccagacttcctatgtactactacgacagcagcgtctcaaccggaagcgtagacgtatggggtcagggtacaatggtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 247 - protein, 214 aa, Artificial
  Synthetic
EIVLTQSPATLSLSPGERATLSCRASQSVSSYLAWYQQKPGQAPRLLIYDSSNRATGIPARFSGSGSGTDFTLTISSLEPEDFAVYYCQQDSDHPITFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 248 - DNA, 642 bp, Artificial
  Synthetic
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgattcatccaacagggccactggcatcccagccaggttcagtggcagtgggtctgggacagacttcactctcaccatcagcagcctagagcctgaagattttgcagtttattactgtcagcaggacagtgaccaccctatcacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 249 - protein, 451 aa, Artificial
  Synthetic
QVQLQQWGAGLLKPSETLSLTCAVYGGSFSDYEWSWIRQPPGKGLEWIGEIDWSGITNYNPSLKSRVTISVDTSKNQFSLKLSSVTAADTAVYYCARLPMYYYDSSVSTGSVDVWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 250 - DNA, 1353 bp, Artificial
  Synthetic
caagtacaattacaacagtggggagctggtttattaaagccttcagaaactttaagtttgacctgtgctgtttacggtggatcattttctgattatgagtggagttggattcgtcaaccaccaggcaaaggattggagtggatcggtgagatagactggtcaggcattactaactacaatccaagtttaaaatccagggttactatctccgtagacacgtccaagaaccagttctccctgaagctgagttctgtgaccgccgcagacacggcggtgtactactgcgccagacttcctatgtactactacgacagcagcgtctcaaccggaagcgtagacgtatggggtcagggtacaatggtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 251 - protein, 8 aa, Artificial
  Synthetic
GGSFSRYY

SEQ ID NO: 252 - protein, 7 aa, Artificial
  Synthetic
IDYSGST

SEQ ID NO: 253 - protein, 16 aa, Artificial
  Synthetic
ARDGVYYDSSDLGFDI

SEQ ID NO: 254 - protein, 9 aa, Artificial
  Synthetic
GSFSRYYWS

SEQ ID NO: 255 - protein, 16 aa, Artificial
  Synthetic
SIDYSGSTEYNPSLKS

SEQ ID NO: 256 - protein, 16 aa, Artificial
  Synthetic
ARDGVYYDSSDLGFDI

SEQ ID NO: 257 - protein, 122 aa, Artificial
  Synthetic
QVQLQQWGAGLLKPSETLSLTCAVYGGSFSRYYWSWIRQPPGKGLEWIGSIDYSGSTEYNPSLKSRVTISVDTSKNQFSLKLSSVTAADTAVYYCARDGVYYDSSDLGFDIWGQGTMVTVSS

SEQ ID NO: 258 - DNA, 366 bp, Artificial
  Synthetic
caagtacaattacaacagtggggagctggtttattaaagccttcagaaactttaagtttgacctgtgctgtttacggtggatcattttctcgttattactggagttggattcgtcaaccaccaggcaaaggattggagtggatcggtagtatagactattcaggctccactgagtacaatccaagtttaaaatccagggttactatctccgtagacacgtccaagaaccagttctccctgaagctgagttctgtgaccgccgcagacacggcggtgtactactgcgccagagatggtgtgtactacgacagcagcgacttgggattcgacatatggggtcagggtacaatggtcaccgtctcctca

SEQ ID NO: 259 - protein, 6 aa, Artificial
  Synthetic
QDISNY

SEQ ID NO: 260 - protein, 3 aa, Artificial
  Synthetic
DAS

SEQ ID NO: 261 - protein, 9 aa, Artificial
  Synthetic
QQYDDLPIT

SEQ ID NO: 262 - protein, 11 aa, Artificial
  Synthetic
QASQDISNYLN

SEQ ID NO: 263 - protein, 7 aa, Artificial
  Synthetic
DASNLET

SEQ ID NO: 264 - protein, 9 aa, Artificial
  Synthetic
QQYDDLPIT

SEQ ID NO: 265 - protein, 107 aa, Artificial
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDDLPITFGGGTKVEIK

SEQ ID NO: 266 - DNA, 321 bp, Artificial
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtacgacgacctccctatcacttttggcggagggaccaaggttgagatcaaa

SEQ ID NO: 267 - protein, 452 aa, Artificial
  Synthetic
QVQLQQWGAGLLKPSETLSLTCAVYGGSFSRYYWSWIRQPPGKGLEWIGSIDYSGSTEYNPSLKSRVTISVDTSKNQFSLKLSSVTAADTAVYYCARDGVYYDSSDLGFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 268 - DNA, 1356 bp, Artificial
  Synthetic
caagtacaattacaacagtggggagctggtttattaaagccttcagaaactttaagtttgacctgtgctgtttacggtggatcattttctcgttattactggagttggattcgtcaaccaccaggcaaaggattggagtggatcggtagtatagactattcaggctccactgagtacaatccaagtttaaaatccagggttactatctccgtagacacgtccaagaaccagttctccctgaagctgagttctgtgaccgccgcagacacggcggtgtactactgcgccagagatggtgtgtactacgacagcagcgacttgggattcgacatatggggtcagggtacaatggtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 269 - protein, 214 aa, Artificial
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDDLPITFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 270 - DNA, 642 bp, Artificial
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtacgacgacctccctatcacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 271 - protein, 448 aa, Artificial
  Synthetic
QVQLQQWGAGLLKPSETLSLTCAVYGGSFSRYYWSWIRQPPGKGLEWIGSIDYSGSTEYNPSLKSRVTISVDTSKNQFSLKLSSVTAADTAVYYCARDGVYYDSSDLGFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 272 - DNA, 1344 bp, Artificial
  Synthetic
caagtacaattacaacagtggggagctggtttattaaagccttcagaaactttaagtttgacctgtgctgtttacggtggatcattttctcgttattactggagttggattcgtcaaccaccaggcaaaggattggagtggatcggtagtatagactattcaggctccactgagtacaatccaagtttaaaatccagggttactatctccgtagacacgtccaagaaccagttctccctgaagctgagttctgtgaccgccgcagacacggcggtgtactactgcgccagagatggtgtgtactacgacagcagcgacttgggattcgacatatggggtcagggtacaatggtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 273 - protein, 8 aa, Artificial
  Synthetic
GGTFSSYA

SEQ ID NO: 274 - protein, 8 aa, Artificial
  Synthetic
IIPIFGTA

SEQ ID NO: 275 - protein, 17 aa, Artificial
  Synthetic
ARLGGRGYADEGWYFDL

SEQ ID NO: 276 - protein, 9 aa, Artificial
  Synthetic
GTFSSYAIS

SEQ ID NO: 277 - protein, 17 aa, Artificial
  Synthetic
GIIPIFGTANYAQKFQG

SEQ ID NO: 278 - protein, 17 aa, Artificial
  Synthetic
ARLGGRGYADEGWYFDL

SEQ ID NO: 279 - protein, 124 aa, Artificial
  Synthetic
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARLGGRGYADEGWYFDLWGRGTLVTVSS

SEQ ID NO: 280 - DNA, 372 bp, Artificial
  Synthetic
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagattgggcggacggggatacgccgacgagggctggtacttcgacctatgggggagaggtaccttggtcaccgtctcctca

SEQ ID NO: 281 - protein, 7 aa, Artificial
  Synthetic
QSVSSSY

SEQ ID NO: 282 - protein, 3 aa, Artificial
  Synthetic
GAS

SEQ ID NO: 283 - protein, 9 aa, Artificial
  Synthetic
QQYYGSPIT

SEQ ID NO: 284 - protein, 12 aa, Artificial
  Synthetic
RASQSVSSSYLA

SEQ ID NO: 285 - protein, 7 aa, Artificial
  Synthetic
GASSRAT

SEQ ID NO: 286 - protein, 9 aa, Artificial
  Synthetic
QQYYGSPIT

SEQ ID NO: 287 - protein, 108 aa, Artificial
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYYGSPITFGGGTKVEIK

SEQ ID NO: 288 - DNA, 324 bp, Artificial
  Synthetic
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtactacggcagtcctatcacttttggcggagggaccaaggttgagatcaaa

SEQ ID NO: 289 - protein, 454 aa, Artificial
  Synthetic
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARLGGRGYADEGWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - DNA, 1362 bp, Artificial
  Synthetic
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagattgggcggacggggatacgccgacgagggctggtacttcgacctatgggggagaggtaccttggtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 291 - protein, 215 aa, Artificial
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYYGSPITFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 292 - DNA, 645 bp, Artificial
  Synthetic
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtactacggcagtcctatcacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 293 - protein, 450 aa, Artificial
  Synthetic
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARLGGRGYADEGWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 294 - DNA, 1350 bp, Artificial
  Synthetic
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagattgggcggacggggatacgccgacgagggctggtacttcgacctatgggggagaggtaccttggtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 295 - protein, 8 aa, Artificial
  Synthetic
GGSFSEYY

SEQ ID NO: 296 - protein, 7 aa, Artificial
  Synthetic
IDEVGST

SEQ ID NO: 297 - protein, 17 aa, Artificial
  Synthetic
ARLPMYYYDSSDLPMDV

SEQ ID NO: 298 - protein, 9 aa, Artificial
  Synthetic
GSFSEYYWA

SEQ ID NO: 299 - protein, 16 aa, Artificial
  Synthetic
EIDEVGSTNYNPSLKS

SEQ ID NO: 300 - protein, 17 aa, Artificial
  Synthetic
ARLPMYYYDSSDLPMDV

SEQ ID NO: 301 - protein, 123 aa, Artificial
  Synthetic
QVQLQQWGAGLLKPSETLSLTCAVYGGSFSEYYWAWIRQPPGKGLEWIGEIDEVGSTNYNPSLKSRVTISVDTSKNQFSLKLSSVTAADTAVYYCARLPMYYYDSSDLPMDVWGQGTTVTVSS

SEQ ID NO: 302 - DNA, 369 bp, Artificial
  Synthetic
caagtacaattacaacagtggggagctggtttattaaagccttcagaaactttaagtttgacctgtgctgtttacggtggatcattttctgagtattactgggcttggattcgtcaaccaccaggcaaaggattggagtggatcggtgagatagacgaggttggctccactaactacaatccaagtttaaaatccagggttactatctccgtagacacgtccaagaaccagttctccctgaagctgagttctgtgaccgccgcagacacggcggtgtactactgcgccagacttcctatgtactactacgacagcagcgacttgccaatggacgtatggggccagggaacaactgtcaccgtctcctca

SEQ ID NO: 303 - protein, 6 aa, Artificial
  Synthetic
QDISNY

SEQ ID NO: 304 - protein, 3 aa, Artificial
  Synthetic
DAS

SEQ ID NO: 305 - protein, 9 aa, Artificial
  Synthetic
QQYDTLPLT

SEQ ID NO: 306 - protein, 11 aa, Artificial
  Synthetic
QASQDISNYLN

SEQ ID NO: 307 - protein, 7 aa, Artificial
  Synthetic
DASNLAT

SEQ ID NO: 308 - protein, 9 aa, Artificial
  Synthetic
QQYDTLPLT

SEQ ID NO: 309 - protein, 107 aa, Artificial
  Synthetic
DIQMTQSPSSLSASVGDRVTITCQASQDISNYLNWYQQKPGKAPKLLIYDASNLATGVPSRFSGSGSGTDFTFTISSLQPEDIATYYCQQYDTLPLTFGGGTKVEIK

SEQ ID NO: 310 - DNA, 321 bp, Artificial
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggcaacaggggtcccatcaaggttcagtggaagtggatctgggacagattttactttcaccatcagcagcctgcagcctgaagatattgcaacatattactgtcagcagtacgataccctccctctcacttttggcggagggaccaaggttgagatcaaa

SEQ ID NO: 311 - protein, 453 aa, Artificial
  Synthetic
QVQLQQWGAGLLKPSETLSLTCAVYGGSFSEYYWAWIRQPPGKGLEWIGEIDEVGSTNYNPSLKSRVTISVDTSKNQFSLKLSSVTAADTAVYYCARLPMYYYDSSDLPMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 312 - DNA, 1359 bp, Artificial
  Synthetic
caagtacaattacaacagtggggagctggtttattaaagccttcagaaactttaagtttgacctgtgctgtttacggtggatcattttctgagtattactgggcttggattcgtcaaccaccaggcaaaggattggagtggatcggtgagatagacgaggttggctccactaactacaatccaagtttaaaatccagggttactatctccgtagacacgtccaagaaccagttctccctgaagctgagttctgtgaccgccgcagacacggcggtgtactactgcgccagacttcctatgtactactacgacagcagcgacttgccaatggacgtatggggccagggaacaactgtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 313 - protein, 214 aa, Artificial
  Synthetic
DIQMTQSPSSLSASVGDRVTITCQASQDISNYLNWYQQKPGKAPKLLIYDASNLATGVPSRFSGSGSGTDFTFTISSLQPEDIATYYCQQYDTLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 314 - DNA, 642 bp, Artificial
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggcaacaggggtcccatcaaggttcagtggaagtggatctgggacagattttactttcaccatcagcagcctgcagcctgaagatattgcaacatattactgtcagcagtacgataccctccctctcacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 315 - protein, 449 aa, Artificial
  Synthetic
QVQLQQWGAGLLKPSETLSLTCAVYGGSFSEYYWAWIRQPPGKGLEWIGEIDEVGSTNYNPSLKSRVTISVDTSKNQFSLKLSSVTAADTAVYYCARLPMYYYDSSDLPMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 316 - DNA, 1347 bp, Artificial
  Synthetic
caagtacaattacaacagtggggagctggtttattaaagccttcagaaactttaagtttgacctgtgctgtttacggtggatcattttctgagtattactgggcttggattcgtcaaccaccaggcaaaggattggagtggatcggtgagatagacgaggttggctccactaactacaatccaagtttaaaatccagggttactatctccgtagacacgtccaagaaccagttctccctgaagctgagttctgtgaccgccgcagacacggcggtgtactactgcgccagacttcctatgtactactacgacagcagcgacttgccaatggacgtatggggccagggaacaactgtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 317 - protein, 8 aa, Artificial
  Synthetic
GGSFSGYY

SEQ ID NO: 318 - protein, 7 aa, Artificial
  Synthetic
IDVDGST

SEQ ID NO: 319 - protein, 14 aa, Artificial
  Synthetic
ARDGYYYDTSPYDV

SEQ ID NO: 320 - protein, 9 aa, Artificial
  Synthetic
GSFSGYYWS

SEQ ID NO: 321 - protein, 16 aa, Artificial
  Synthetic
EIDVDGSTNYNPSLKS

SEQ ID NO: 322 - protein, 14 aa, Artificial
  Synthetic
ARDGYYYDTSPYDV

SEQ ID NO: 323 - protein, 120 aa, Artificial
  Synthetic
QVQLQQWGAGLLKPSETLSLTCAVYGGSFSGYYWSWIRQPPGKGLEWIGEIDVDGSTNYNPSLKSRVTISVDTSKNQFSLKLSSVTAADTAVYYCARDGYYYDTSPYDVWGQGTMVTVSS

SEQ ID NO: 324 - DNA, 360 bp, Artificial
  Synthetic
caagtacaattacaacagtggggagctggtttattaaagccttcagaaactttaagtttgacctgtgctgtttacggtggatcattttctggttattactggagttggattcgtcaaccaccaggcaaaggattggagtggatcggtgagatagacgtggatggctccactaactacaatccaagtttaaaatccagggttactatctccgtagacacgtccaagaaccagttctccctgaagctgagttctgtgaccgccgcagacacggcggtgtactactgcgccagagacggatactactacgacaccagtccatacgacgtatggggtcagggtacaatggtcaccgtctcctca

SEQ ID NO: 325 - protein, 6 aa, Artificial
  Synthetic
QSVSSY

SEQ ID NO: 326 - protein, 3 aa, Artificial
  Synthetic
DAS

SEQ ID NO: 327 - protein, 9 aa, Artificial
  Synthetic
QQRDSFPLT

SEQ ID NO: 328 - protein, 11 aa, Artificial
  Synthetic
RASQSVSSYLA

SEQ ID NO: 329 - protein, 7 aa, Artificial
  Synthetic
DASNRAT

SEQ ID NO: 330 - protein, 9 aa, Artificial
  Synthetic
QQRDSFPLT

SEQ ID NO: 331 - protein, 107 aa, Artificial
  Synthetic
EIVLTQSPATLSLSPGERATLSCRASQSVSSYLAWYQQKPGQAPRLLIYDASNRATGIPARFSGSGSGTDFTLTISSLEPEDFAVYYCQQRDSFPLTFGGGTKVEIK

SEQ ID NO: 332 - DNA, 321 bp, Artificial
  Synthetic
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagagactccttccctctcacttttggcggagggaccaaggttgagatcaaa

SEQ ID NO: 333 - protein, 450 aa, Artificial
  Synthetic
QVQLQQWGAGLLKPSETLSLTCAVYGGSFSGYYWSWIRQPPGKGLEWIGEIDVDGSTNYNPSLKSRVTISVDTSKNQFSLKLSSVTAADTAVYYCARDGYYYDTSPYDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 334 - DNA, 1350 bp, Artificial
  Synthetic
caagtacaattacaacagtggggagctggtttattaaagccttcagaaactttaagtttgacctgtgctgtttacggtggatcattttctggttattactggagttggattcgtcaaccaccaggcaaaggattggagtggatcggtgagatagacgtggatggctccactaactacaatccaagtttaaaatccagggttactatctccgtagacacgtccaagaaccagttctccctgaagctgagttctgtgaccgccgcagacacggcggtgtactactgcgccagagacggatactactacgacaccagtccatacgacgtatggggtcagggtacaatggtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 335 - protein, 214 aa, Artificial
  Synthetic
EIVLTQSPATLSLSPGERATLSCRASQSVSSYLAWYQQKPGQAPRLLIYDASNRATGIPARFSGSGSGTDFTLTISSLEPEDFAVYYCQQRDSFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 336 - DNA, 642 bp, Artificial
  Synthetic
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagagactccttccctctcacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 337 - protein, 446 aa, Artificial
  Synthetic
QVQLQQWGAGLLKPSETLSLTCAVYGGSFSGYYWSWIRQPPGKGLEWIGEIDVDGSTNYNPSLKSRVTISVDTSKNQFSLKLSSVTAADTAVYYCARDGYYYDTSPYDVWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 338 - DNA, 1338 bp, Artificial
  Synthetic
caagtacaattacaacagtggggagctggtttattaaagccttcagaaactttaagtttgacctgtgctgtttacggtggatcattttctggttattactggagttggattcgtcaaccaccaggcaaaggattggagtggatcggtgagatagacgtggatggctccactaactacaatccaagtttaaaatccagggttactatctccgtagacacgtccaagaaccagttctccctgaagctgagttctgtgaccgccgcagacacggcggtgtactactgcgccagagacggatactactacgacaccagtccatacgacgtatggggtcagggtacaatggtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 339 - protein, 8 aa, Artificial
  Synthetic
GGTFVGYA

SEQ ID NO: 340 - protein, 8 aa, Artificial
  Synthetic
IIPIFGIA

SEQ ID NO: 341 - protein, 17 aa, Artificial
  Synthetic
ARSYYSSRWHYYYYMDV

SEQ ID NO: 342 - protein, 9 aa, Artificial
  Synthetic
GTFVGYAIS

SEQ ID NO: 343 - protein, 17 aa, Artificial
  Synthetic
GIIPIFGIANYAQKFQG

SEQ ID NO: 344 - protein, 17 aa, Artificial
  Synthetic
ARSYYSSRWHYYYYMDV

SEQ ID NO: 345 - protein, 124 aa, Artificial
  Synthetic
QVQLVQSGAEVKKPGSSVKVSCKASGGTFVGYAISWVRQAPGQGLEWMGGIIPIFGIANYAQKFQGRVTITADESTSTAYMELSSLRSEDTAVYYCARSYYSSRWHYYYYMDVWGKGTTVTVSS

SEQ ID NO: 346 - DNA, 372 bp, Artificial
  Synthetic
caggtgcagctggtgcagtctggggctgaggtgaagaagcctgggtcctcggtgaaggtctcctgcaaggcttctggaggcaccttcgttgggtatgctatcagctgggtgcgacaggcccctggacaagggcttgagtggatgggagggatcatccctatctttggtattgcaaactacgcacagaagttccagggcagagtcacgattaccgcggacgaatccacgagcacagcctacatggagctgagcagcctgagatctgaggacacggcggtgtactactgcgccagatcttactactccagccgatggcactactactactacatggacgtgtggggcaagggtacaactgtcaccgtctcctca

SEQ ID NO: 347 - protein, 6 aa, Artificial
  Synthetic
QGISSW

SEQ ID NO: 348 - protein, 3 aa, Artificial
  Synthetic
AAS

SEQ ID NO: 349 - protein, 9 aa, Artificial
  Synthetic
QQADDLPLT

SEQ ID NO: 350 - protein, 11 aa, Artificial
  Synthetic
RASQGISSWLA

SEQ ID NO: 351 - protein, 7 aa, Artificial
  Synthetic
AASNLQS

SEQ ID NO: 352 - protein, 9 aa, Artificial
  Synthetic
QQADDLPLT

SEQ ID NO: 353 - protein, 107 aa, Artificial; identical to SEQ ID NO: 199
  Synthetic

SEQ ID NO: 354 - DNA, 321 bp, Artificial
  Synthetic
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccaatttgcaaagtggggtcccatcaaggttcagcggcagtggatctgggacagatttcactctcaccatcagcagcctgcagcctgaagattttgcaacttattactgtcagcaggcagacgacctccctctcacttttggcggagggaccaaggttgagatcaaa

SEQ ID NO: 355 - protein, 454 aa, Artificial
  Synthetic
QVQLVQSGAEVKKPGSSVKVSCKASGGTFVGYAISWVRQAPGQGLEWMGGIIPIFGIANYAQKFQGRVTITADESTSTAYMELSSLRSEDTAVYYCARSYYSSRWHYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 356 - DNA, 1362 bp, Artificial
  Synthetic
caggtgcagctggtgcagtctggggctgaggtgaagaagcctgggtcctcggtgaaggtctcctgcaaggcttctggaggcaccttcgttgggtatgctatcagctgggtgcgacaggcccctggacaagggcttgagtggatgggagggatcatccctatctttggtattgcaaactacgcacagaagttccagggcagagtcacgattaccgcggacgaatccacgagcacagcctacatggagctgagcagcctgagatctgaggacacggcggtgtactactgcgccagatcttactactccagccgatggcactactactactacatggacgtgtggggcaagggtacaactgtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 357 - protein, 214 aa, Artificial; identical to SEQ ID NO: 203
  Synthetic

SEQ ID NO: 358 - DNA, 642 bp, Artificial
  Synthetic
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccaatttgcaaagtggggtcccatcaaggttcagcggcagtggatctgggacagatttcactctcaccatcagcagcctgcagcctgaagattttgcaacttattactgtcagcaggcagacgacctccctctcacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 359 - protein, 450 aa, Artificial
  Synthetic
QVQLVQSGAEVKKPGSSVKVSCKASGGTFVGYAISWVRQAPGQGLEWMGGIIPIFGIANYAQKFQGRVTITADESTSTAYMELSSLRSEDTAVYYCARSYYSSRWHYYYYMDVWGKGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 360 - DNA, 1350 bp, Artificial
  Synthetic
caggtgcagctggtgcagtctggggctgaggtgaagaagcctgggtcctcggtgaaggtctcctgcaaggcttctggaggcaccttcgttgggtatgctatcagctgggtgcgacaggcccctggacaagggcttgagtggatgggagggatcatccctatctttggtattgcaaactacgcacagaagttccagggcagagtcacgattaccgcggacgaatccacgagcacagcctacatggagctgagcagcctgagatctgaggacacggcggtgtactactgcgccagatcttactactccagccgatggcactactactactacatggacgtgtggggcaagggtacaactgtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 361 - protein, 8 aa, Artificial
  Synthetic
GFTFSSYG

SEQ ID NO: 362 - protein, 8 aa, Artificial
  Synthetic
IKQDGSEK

SEQ ID NO: 363 - protein, 15 aa, Artificial
  Synthetic
ARDAPWDIYDYYMDV

SEQ ID NO: 364 - protein, 9 aa, Artificial
  Synthetic
FTFSSYGMS

SEQ ID NO: 365 - protein, 17 aa, Artificial
  Synthetic
NIKQDGSEKYYVDSVKG

SEQ ID NO: 366 - protein, 15 aa, Artificial
  Synthetic
ARDAPWDIYDYYMDV

SEQ ID NO: 367 - protein, 122 aa, Artificial
  Synthetic
EVQLVESGGGLVQPGGSLRLSCAASGFTFSSYGMSWVRQAPGKGLEWVANIKQDGSEKYYVDSVKGRFTISRDNAKNSLYLQMNSLRAEDTAVYYCARDAPWDIYDYYMDVWGKGTTVTVSS

SEQ ID NO: 368 - DNA, 366 bp, Artificial
  Synthetic
gaggtgcagctggtggagtctgggggaggcttggtccagcctggggggtccctgagactctcctgtgcagcctctggattcacctttagtagctatgggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggcggtgtactactgcgccagagatgctccttgggacatctacgactactacatggacgtatggggcaagggtacaactgtcaccgtctcctca

SEQ ID NO: 369 - protein, 6 aa, Artificial
  Synthetic
QSISSY

SEQ ID NO: 370 - protein, 3 aa, Artificial
  Synthetic
AAS

SEQ ID NO: 371 - protein, 9 aa, Artificial
  Synthetic
QQSYVPPWT

SEQ ID NO: 372 - protein, 11 aa, Artificial
  Synthetic
RASQSISSYLN

SEQ ID NO: 373 - protein, 7 aa, Artificial
  Synthetic
AASSLQS

SEQ ID NO: 374 - protein, 9 aa, Artificial
  Synthetic
QQSYVPPWT

SEQ ID NO: 375 - protein, 107 aa, Artificial
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYVPPWTFGGGTKVEIK

SEQ ID NO: 376 - DNA, 321 bp, Artificial
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcagcaaagctacgtccccccttggacttttggcggagggaccaaggttgagatcaaa

SEQ ID NO: 377 - protein, 452 aa, Artificial
  Synthetic
EVQLVESGGGLVQPGGSLRLSCAASGFTFSSYGMSWVRQAPGKGLEWVANIKQDGSEKYYVDSVKGRFTISRDNAKNSLYLQMNSLRAEDTAVYYCARDAPWDIYDYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 378 - DNA, 1356 bp, Artificial
  Synthetic
gaggtgcagctggtggagtctgggggaggcttggtccagcctggggggtccctgagactctcctgtgcagcctctggattcacctttagtagctatgggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggcggtgtactactgcgccagagatgctccttgggacatctacgactactacatggacgtatggggcaagggtacaactgtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 379 - protein, 214 aa, Artificial
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYVPPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 380 - DNA, 642 bp, Artificial
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcagcaaagctacgtccccccttggacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 381 - protein, 448 aa, Artificial
  Synthetic
EVQLVESGGGLVQPGGSLRLSCAASGFTFSSYGMSWVRQAPGKGLEWVANIKQDGSEKYYVDSVKGRFTISRDNAKNSLYLQMNSLRAEDTAVYYCARDAPWDIYDYYMDVWGKGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 382 - DNA, 1344 bp, Artificial
  Synthetic
gaggtgcagctggtggagtctgggggaggcttggtccagcctggggggtccctgagactctcctgtgcagcctctggattcacctttagtagctatgggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggcggtgtactactgcgccagagatgctccttgggacatctacgactactacatggacgtatggggcaagggtacaactgtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 383 - protein, 8 aa, Artificial
  Synthetic
GFTFSSYG

SEQ ID NO: 384 - protein, 8 aa, Artificial
  Synthetic
IWYDGSNK

SEQ ID NO: 385 - protein, 10 aa, Artificial
  Synthetic
ARGAPEYVDV

SEQ ID NO: 386 - protein, 9 aa, Artificial
  Synthetic
FTFSSYGMH

SEQ ID NO: 387 - protein, 17 aa, Artificial
  Synthetic
VIWYDGSNKYYADSVKG

SEQ ID NO: 388 - protein, 10 aa, Artificial
  Synthetic
ARGAPEYVDV

SEQ ID NO: 389 - protein, 117 aa, Artificial
  Synthetic
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGAPEYVDVWGQGTMVTVSS

SEQ ID NO: 390 - DNA, 351 bp, Artificial
  Synthetic
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggcggtgtactactgcgccagaggggcccctgaatatgtagacgtatggggtcagggtacaatggtcaccgtctcctca

SEQ ID NO: 391 - protein, 6 aa, Artificial
  Synthetic
QSVSSY

SEQ ID NO: 392 - protein, 3 aa, Artificial
  Synthetic
DSS

SEQ ID NO: 393 - protein, 8 aa, Artificial
  Synthetic
QQYSLYPT

SEQ ID NO: 394 - protein, 11 aa, Artificial
  Synthetic
RASQSVSSYLA

SEQ ID NO: 395 - protein, 7 aa, Artificial
  Synthetic
DSSNRAT

SEQ ID NO: 396 - protein, 8 aa, Artificial
  Synthetic
QQYSLYPT

SEQ ID NO: 397 - protein, 106 aa, Artificial
  Synthetic
EIVLTQSPATLSLSPGERATLSCRASQSVSSYLAWYQQKPGQAPRLLIYDSSNRATGIPARFSGSGSGTDFTLTISSLEPEDFAVYYCQQYSLYPTFGGGTKVEIK

SEQ ID NO: 398 - DNA, 318 bp, Artificial
  Synthetic
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgattcatccaacagggccactggcatcccagccaggttcagtggcagtgggtctgggacagacttcactctcaccatcagcagcctagagcctgaagattttgcagtttattactgtcagcagtacagtctctaccctacttttggcggagggaccaaggttgagatcaaa

SEQ ID NO: 399 - protein, 447 aa, Artificial
  Synthetic
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGAPEYVDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 400 - DNA, 1341 bp, Artificial
  Synthetic
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggcggtgtactactgcgccagaggggcccctgaatatgtagacgtatggggtcagggtacaatggtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 401 - protein, 213 aa, Artificial
  Synthetic
EIVLTQSPATLSLSPGERATLSCRASQSVSSYLAWYQQKPGQAPRLLIYDSSNRATGIPARFSGSGSGTDFTLTISSLEPEDFAVYYCQQYSLYPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 402 - DNA, 639 bp, Artificial
  Synthetic
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgattcatccaacagggccactggcatcccagccaggttcagtggcagtgggtctgggacagacttcactctcaccatcagcagcctagagcctgaagattttgcagtttattactgtcagcagtacagtctctaccctacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 403 - protein, 443 aa, Artificial
  Synthetic
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGAPEYVDVWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 404 - DNA, 1329 bp, Artificial
  Synthetic
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggcggtgtactactgcgccagaggggcccctgaatatgtagacgtatggggtcagggtacaatggtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 405 - protein, 8 aa, Artificial
  Synthetic
DYKDDDDK

SEQ ID NO: 406 - protein, 6 aa, Artificial
  Synthetic
HHHHHH

SEQ ID NO: 407 - protein, 9 aa, Artificial
  Synthetic
YPYDVPDYA

SEQ ID NO: 408 - protein, 8 aa, Artificial
  Synthetic
  misc_feature (5)..(8): Xaa can be any naturally occurring amino acid
GFTFXXXX

SEQ ID NO: 409 - protein, 8 aa, Artificial
  Synthetic
  misc_feature (5)..(6): Xaa can be any naturally occurring amino acid
ISSSXXYI

SEQ ID NO: 410 - protein, 9 aa, Artificial
  Synthetic
  misc_feature (4)..(7): Xaa can be any naturally occurring amino acid
FTFXXXXMN

SEQ ID NO: 411 - protein, 17 aa, Artificial
  Synthetic
  misc_feature (1)..(1): Xaa can be any naturally occurring amino acid
  misc_feature (6)..(7): Xaa can be any naturally occurring amino acid
  misc_feature (10)..(10): Xaa can be any naturally occurring amino acid
XISSSXXYIXYADSVKG

SEQ ID NO: 412 - protein, 8 aa, Artificial
  Synthetic
  misc_feature (5)..(8): Xaa can be any naturally occurring amino acid
GFTFXXXX

SEQ ID NO: 413 - protein, 8 aa, Artificial
  Synthetic
  misc_feature (5)..(6): Xaa can be any naturally occurring amino acid
ISSSXXYI

SEQ ID NO: 414 - protein, 9 aa, Artificial
  Synthetic
  misc_feature (4)..(7): Xaa can be any naturally occurring amino acid
FTFXXXXMN

SEQ ID NO: 415 - protein, 17 aa, Artificial
  Synthetic
  misc_feature (1)..(1): Xaa can be any naturally occurring amino acid
  misc_feature (6)..(7): Xaa can be any naturally occurring amino acid
  misc_feature (10)..(10): Xaa can be any naturally occurring amino acid
XISSSXXYIXYADSVKG

SEQ ID NO: 416 - protein, 8 aa, Artificial
  Synthetic
  misc_feature (6)..(6): Xaa can be any naturally occurring amino acid
  misc_feature (8)..(8): Xaa can be any naturally occurring amino acid
GGSFSXYX

SEQ ID NO: 417 - protein, 7 aa, Artificial
  Synthetic
  misc_feature (3)..(3): Xaa can be any naturally occurring amino acid
  misc_feature (6)..(6): Xaa can be any naturally occurring amino acid
IDXSGXT

SEQ ID NO: 418 - protein, 17 aa, Artificial
  Synthetic
  misc_feature (3)..(5): Xaa can be any naturally occurring amino acid
  misc_feature (8)..(8): Xaa can be any naturally occurring amino acid
  misc_feature (12)..(15): Xaa can be any naturally occurring amino acid
  misc_feature (17)..(17): Xaa can be any naturally occurring amino acid
ARXXXYYXDSSXXXXDX

SEQ ID NO: 419 - protein, 6 aa, Artificial
  Synthetic
  misc_feature (2)..(3): Xaa can be any naturally occurring amino acid
  misc_feature (5)..(5): Xaa can be any naturally occurring amino acid
QXXSXY

SEQ ID NO: 420 - protein, 3 aa, Artificial
  Synthetic
  misc_feature (2)..(2): Xaa can be any naturally occurring amino acid
DXS

SEQ ID NO: 421 - protein, 9 aa, Artificial
  Synthetic
  misc_feature (3)..(4): Xaa can be any naturally occurring amino acid
  misc_feature (6)..(6): Xaa can be any naturally occurring amino acid
QQXXDXPIT

SEQ ID NO: 422 - protein, 9 aa, Artificial
  Synthetic
  misc_feature (5)..(5): Xaa can be any naturally occurring amino acid
  misc_feature (7)..(7): Xaa can be any naturally occurring amino acid
GSFSXYXWS

SEQ ID NO: 423 - protein, 16 aa, Artificial
  Synthetic
  misc_feature (4)..(4): Xaa can be any naturally occurring amino acid
  misc_feature (7)..(7): Xaa can be any naturally occurring amino acid
  misc_feature (9)..(9): Xaa can be any naturally occurring amino acid
SIDXSGXTXYNPSLKS

SEQ ID NO: 424 - protein, 11 aa, Artificial
  Synthetic
  misc_feature (1)..(1): Xaa can be any naturally occurring amino acid
  misc_feature (5)..(6): Xaa can be any naturally occurring amino acid
  misc_feature (8)..(8): Xaa can be any naturally occurring amino acid
  misc_feature (11)..(11): Xaa can be any naturally occurring amino acid
XASQXXSXYLX

SEQ ID NO: 425 - protein, 7 aa, Artificial
  Synthetic
  misc_feature (2)..(2): Xaa can be any naturally occurring amino acid
  misc_feature (5)..(6): Xaa can be any naturally occurring amino acid
DXSNXXT

SEQ ID NO: 426 - protein, 8 aa, Artificial
  Synthetic
  misc_feature (6)..(6): Xaa can be any naturally occurring amino acid
  misc_feature (8)..(8): Xaa can be any naturally occurring amino acid
GGSFSXYX

SEQ ID NO: 427 - protein, 7 aa, Artificial
  Synthetic
  misc_feature (3)..(3): Xaa can be any naturally occurring amino acid
  misc_feature (6)..(6): Xaa can be any naturally occurring amino acid
IDXSGXT

SEQ ID NO: 428 - protein, 17 aa, Artificial
  Synthetic
  misc_feature (3)..(5): Xaa can be any naturally occurring amino acid
  misc_feature (8)..(8): Xaa can be any naturally occurring amino acid
  misc_feature (12)..(15): Xaa can be any naturally occurring amino acid
  misc_feature (17)..(17): Xaa can be any naturally occurring amino acid
ARXXXYYXDSSXXXXDX

SEQ ID NO: 429 - protein, 6 aa, Artificial
  Synthetic
  misc_feature (2)..(3): Xaa can be any naturally occurring amino acid
  misc_feature (5)..(5): Xaa can be any naturally occurring amino acid
QXXSXY

SEQ ID NO: 430 - protein, 3 aa, Artificial
  Synthetic
  misc_feature (2)..(2): Xaa can be any naturally occurring amino acid
DXS

SEQ ID NO: 431 - protein, 9 aa, Artificial
  Synthetic
  misc_feature (3)..(4): Xaa can be any naturally occurring amino acid
  misc_feature (6)..(6): Xaa can be any naturally occurring amino acid
QQXXDXPIT

SEQ ID NO: 432 - protein, 9 aa, Artificial
  Synthetic
  misc_feature (5)..(5): Xaa can be any naturally occurring amino acid
  misc_feature (7)..(7): Xaa can be any naturally occurring amino acid
GSFSXYXWS

SEQ ID NO: 433 - protein, 16 aa, Artificial
  Synthetic
  misc_feature (4)..(4): Xaa can be any naturally occurring amino acid
  misc_feature (7)..(7): Xaa can be any naturally occurring amino acid
  misc_feature (9)..(9): Xaa can be any naturally occurring amino acid
SIDXSGXTXYNPSLKS

SEQ ID NO: 434 - protein, 11 aa, Artificial
  Synthetic
  misc_feature (1)..(1): Xaa can be any naturally occurring amino acid
  misc_feature (5)..(6): Xaa can be any naturally occurring amino acid
  misc_feature (8)..(8): Xaa can be any naturally occurring amino acid
  misc_feature (11)..(11): Xaa can be any naturally occurring amino acid
XASQXXSXYLX

SEQ ID NO: 435 - protein, 7 aa, Artificial
  Synthetic
  misc_feature (2)..(2): Xaa can be any naturally occurring amino acid
  misc_feature (5)..(6): Xaa can be any naturally occurring amino acid
DXSNXXT

SEQ ID NO: 436 - protein, 8 aa, Artificial
  Synthetic
  misc_feature (2)..(3): Xaa can be any naturally occurring amino acid
  misc_feature (7)..(7): Xaa can be any naturally occurring amino acid
IXXDGSXK

SEQ ID NO: 437 - protein, 10 aa, Artificial
  Synthetic
  misc_feature (3)..(3): Xaa can be any naturally occurring amino acid
  misc_feature (6)..(8): Xaa can be any naturally occurring amino acid
ARXAPXXXDV

SEQ ID NO: 438 - protein, 6 aa, Artificial
  Synthetic
  misc_feature (3)..(3): Xaa can be any naturally occurring amino acid
QSXSSY

SEQ ID NO: 439 - protein, 3 aa, Artificial
  Synthetic
  misc_feature (1)..(2): Xaa can be any naturally occurring amino acid
XXS

SEQ ID NO: 440 - protein, 9 aa, Artificial
  Synthetic
  misc_feature (3)..(6): Xaa can be any naturally occurring amino acid
  misc_feature (8)..(8): Xaa can be any naturally occurring amino acid
QQXXXXPXT

SEQ ID NO: 441 - protein, 9 aa, Artificial
  Synthetic
  misc_feature (9)..(9): Xaa can be any naturally occurring amino acid
FTFSSYGMX

SEQ ID NO: 442 - protein, 17 aa, Artificial
  Synthetic
  misc_feature (1)..(1): Xaa can be any naturally occurring amino acid
  misc_feature (3)..(4): Xaa can be any naturally occurring amino acid
  misc_feature (8)..(8): Xaa can be any naturally occurring amino acid
  misc_feature (12)..(12): Xaa can be any naturally occurring amino acid
XIXXDGSXKYYXDSVKG

SEQ ID NO: 443 - protein, 11 aa, Artificial
  Synthetic
  misc_feature (6)..(6): Xaa can be any naturally occurring amino acid
  misc_feature (11)..(11): Xaa can be any naturally occurring amino acid
RASQSXSSYLX

SEQ ID NO: 444 - protein, 6 aa, Artificial
  Synthetic
  misc_feature (1)..(1): Xaa can be any naturally occurring amino acid
  misc_feature (4)..(6): Xaa can be any naturally occurring amino acid
XSSXXX

SEQ ID NO: 445 - protein, 8 aa, Artificial
  Synthetic
  misc_feature (2)..(3): Xaa can be any naturally occurring amino acid
  misc_feature (7)..(7): Xaa can be any naturally occurring amino acid
IXXDGSXK

SEQ ID NO: 446 - protein, 10 aa, Artificial
  Synthetic
  misc_feature (3)..(3): Xaa can be any naturally occurring amino acid
  misc_feature (6)..(8): Xaa can be any naturally occurring amino acid
ARXAPXXXDV

SEQ ID NO: 447 - protein, 6 aa, Artificial
  Synthetic
  misc_feature (3)..(3): Xaa can be any naturally occurring amino acid
QSXSSY

SEQ ID NO: 448 - protein, 3 aa, Artificial
  Synthetic
  misc_feature (1)..(2): Xaa can be any naturally occurring amino acid
XXS

SEQ ID NO: 449 - protein, 9 aa, Artificial
  Synthetic
  misc_feature (3)..(6): Xaa can be any naturally occurring amino acid
  misc_feature (8)..(8): Xaa can be any naturally occurring amino acid
QQXXXXPXT

SEQ ID NO: 450 - protein, 9 aa, Artificial
  Synthetic
  misc_feature (9)..(9): Xaa can be any naturally occurring amino acid
FTFSSYGMX

SEQ ID NO: 451 - protein, 17 aa, Artificial
  Synthetic
  misc_feature (1)..(1): Xaa can be any naturally occurring amino acid
  misc_feature (3)..(4): Xaa can be any naturally occurring amino acid
  misc_feature (8)..(8): Xaa can be any naturally occurring amino acid
  misc_feature (12)..(12): Xaa can be any naturally occurring amino acid
XIXXDGSXKYYXDSVKG

SEQ ID NO: 452 - protein, 11 aa, Artificial
  Synthetic
  misc_feature (6)..(6): Xaa can be any naturally occurring amino acid
  misc_feature (11)..(11): Xaa can be any naturally occurring amino acid
RASQSXSSYLX

SEQ ID NO: 453 - protein, 6 aa, Artificial
  Synthetic
  misc_feature (1)..(1): Xaa can be any naturally occurring amino acid
  misc_feature (4)..(6): Xaa can be any naturally occurring amino acid
XSSXXX

SEQ ID NO: 454 - protein, 8 aa, Artificial
  Synthetic
  misc_feature (5)..(8): Xaa can be any naturally occurring amino acid
GFTFXXXX

SEQ ID NO: 455 - protein, 8 aa, Artificial
  Synthetic
  misc_feature (2)..(8): Xaa can be any naturally occurring amino acid
IXXXXXXX

SEQ ID NO: 456 - protein, 8 aa, Artificial
  Synthetic
  misc_feature (2)..(8): Xaa can be any naturally occurring amino acid
IXXXXXXX

SEQ ID NO: 457 - protein, 10 aa, Artificial
  Synthetic
  misc_feature (3)..(8): Xaa can be any naturally occurring amino acid
  misc_feature (10)..(10): Xaa can be any naturally occurring amino acid
ARXXXXXXDX

SEQ ID NO: 458 - protein, 10 aa, Artificial
  Synthetic
  misc_feature (3)..(8): Xaa can be any naturally occurring amino acid
  misc_feature (10)..(10): Xaa can be any naturally occurring amino acid
ARXXXXXXDX

SEQ ID NO: 459 - protein, 10 aa, Artificial
  Synthetic
  misc_feature (3)..(3): Xaa can be any naturally occurring amino acid
  misc_feature (6)..(9): Xaa can be any naturally occurring amino acid
QSXSSXXXXY

SEQ ID NO: 460 - protein, 7 aa, Artificial
  Synthetic
  misc_feature (3)..(3): Xaa can be any naturally occurring amino acid
  misc_feature (6)..(6): Xaa can be any naturally occurring amino acid
QSXSSXY

SEQ ID NO: 461 - protein, 3 aa, Artificial
  Synthetic
  misc_feature (1)..(2): Xaa can be any naturally occurring amino acid
XXS

SEQ ID NO: 462 - protein, 3 aa, Artificial
  Synthetic
  misc_feature (1)..(2): Xaa can be any naturally occurring amino acid
XXS

SEQ ID NO: 463 - protein, 9 aa, Artificial
  Synthetic
  misc_feature (3)..(6): Xaa can be any naturally occurring amino acid
  misc_feature (8)..(8): Xaa can be any naturally occurring amino acid
QQXXXXPXT

SEQ ID NO: 464 - protein, 9 aa, Artificial
  Synthetic
  misc_feature (3)..(6): Xaa can be any naturally occurring amino acid
  misc_feature (8)..(8): Xaa can be any naturally occurring amino acid
QQXXXXPXT

SEQ ID NO: 465 - protein, 9 aa, Artificial
  Synthetic
  misc_feature (4)..(7): Xaa can be any naturally occurring amino acid
  misc_feature (9)..(9): Xaa can be any naturally occurring amino acid
FTFXXXXMX

SEQ ID NO: 466 - protein, 9 aa, Artificial
  Synthetic
  misc_feature (4)..(7): Xaa can be any naturally occurring amino acid
  misc_feature (9)..(9): Xaa can be any naturally occurring amino acid
FTFXXXXMX

SEQ ID NO: 467 - protein, 17 aa, Artificial
  Synthetic
  misc_feature (1)..(1): Xaa can be any naturally occurring amino acid
  misc_feature (3)..(10): Xaa can be any naturally occurring amino acid
  misc_feature (12)..(12): Xaa can be any naturally occurring amino acid
XIXXXXXXXXYXDSVKG

SEQ ID NO: 468 - protein, 17 aa, Artificial
  Synthetic
  misc_feature (1)..(1): Xaa can be any naturally occurring amino acid
  misc_feature (3)..(10): Xaa can be any naturally occurring amino acid
  misc_feature (12)..(12): Xaa can be any naturally occurring amino acid
XIXXXXXXXXYXDSVKG

SEQ ID NO: 469 - protein, 11 aa, Artificial
  Synthetic
  misc_feature (3)..(9): Xaa can be any naturally occurring amino acid
  misc_feature (11)..(11): Xaa can be any naturally occurring amino acid
ARXXXXXXXDX

SEQ ID NO: 470 - protein, 11 aa, Artificial
  Synthetic
  misc_feature (3)..(9): Xaa can be any naturally occurring amino acid
  misc_feature (11)..(11): Xaa can be any naturally occurring amino acid
ARXXXXXXXDX

SEQ ID NO: 471 - protein, 11 aa, Artificial
  Synthetic
  misc_feature (6)..(6): Xaa can be any naturally occurring amino acid
  misc_feature (11)..(11): Xaa can be any naturally occurring amino acid
RASQSXSSYLX

SEQ ID NO: 472 - protein, 11 aa, Artificial
  Synthetic
  misc_feature (6)..(6): Xaa can be any naturally occurring amino acid
  misc_feature (11)..(11): Xaa can be any naturally occurring amino acid
RASQSXSSYLX

SEQ ID NO: 473 - protein, 6 aa, Artificial
  Synthetic
  misc_feature (1)..(1): Xaa can be any naturally occurring amino acid
  misc_feature (3)..(6): Xaa can be any naturally occurring amino acid
XSXXXX

SEQ ID NO: 474 - protein, 6 aa, Artificial
  Synthetic
  misc_feature (1)..(1): Xaa can be any naturally occurring amino acid
  misc_feature (3)..(6): Xaa can be any naturally occurring amino acid
XSXXXX

SEQ ID NO: 475 - protein, 9 aa, Artificial
  Synthetic
  misc_feature (3)..(6): Xaa can be any naturally occurring amino acid
  misc_feature (8)..(8): Xaa can be any naturally occurring amino acid
QQXXXXPXT

SEQ ID NO: 476 - protein, 9 aa, Artificial
  Synthetic
  misc_feature (3)..(6): Xaa can be any naturally occurring amino acid
  misc_feature (8)..(8): Xaa can be any naturally occurring amino acid
QQXXXXPXT

SEQ ID NO: 477 - protein, 26 aa, Artificial
  Synthetic
QVQLVQSGAEVKKPGSSVKVSCKASG

SEQ ID NO: 478 - protein, 26 aa, Artificial
  Synthetic
QVQLQQWGAGLLKPSETLSLTCAVYG

SEQ ID NO: 479 - protein, 26 aa, Artificial
  Synthetic
EVQLVESGGGLVKPGGSLRLSCAASG

SEQ ID NO: 480 - protein, 26 aa, Artificial
  Synthetic
EVQLVESGGGLVQPGGSLRLSCAASG

SEQ ID NO: 481 - protein, 26 aa, Artificial
  Synthetic
QVQLVESGGGVVQPGRSLRLSCAASG

SEQ ID NO: 482 - protein, 26 aa, Artificial
  Synthetic
QVQLQQWGAGLLKPSETLSLTCAVYG

SEQ ID NO: 483 - protein, 9 aa, Artificial
  Synthetic
GTFVGYAIS

SEQ ID NO: 484 - protein, 9 aa, Artificial
  Synthetic
GTFSAYAIS

SEQ ID NO: 485 - protein, 9 aa, Artificial
  Synthetic
GTFESYTIS

SEQ ID NO: 486 - protein, 9 aa, Artificial
  Synthetic
GTFSSYAIS

SEQ ID NO: 487 - protein, 9 aa, Artificial
  Synthetic
GSFSEYYWA

SEQ ID NO: 488 - protein, 9 aa, Artificial
  Synthetic
GSFSRYYWS

SEQ ID NO: 489 - protein, 9 aa, Artificial
  Synthetic
GSFSGYYWS

SEQ ID NO: 490 - protein, 9 aa, Artificial
  Synthetic
FTFSSYSMN

SEQ ID NO: 491 - protein, 9 aa, Artificial
  Synthetic
FTFRSYGMN

SEQ ID NO: 492 - protein, 9 aa, Artificial
  Synthetic
FTFSRTGMN

SEQ ID NO: 493 - protein, 9 aa, Artificial
  Synthetic
FTFSRYGMN

SEQ ID NO: 494 - protein, 9 aa, Artificial
  Synthetic
FTFASYGMN

SEQ ID NO: 495 - protein, 9 aa, Artificial
  Synthetic
FTFRSYGMN

SEQ ID NO: 496 - protein, 9 aa, Artificial
  Synthetic
FTFSSYGMS

SEQ ID NO: 497 - protein, 9 aa, Artificial
  Synthetic
FTFSSYGMH

SEQ ID NO: 498 - protein, 9 aa, Artificial
  Synthetic
GSFSDYEWS

SEQ ID NO: 499 - protein, 14 aa, Artificial
  Synthetic
WVRQAPGQGLEWMG

SEQ ID NO: 500 - protein, 14 aa, Artificial
  Synthetic
WIRQPPGKGLEWIG

SEQ ID NO: 501 - protein, 14 aa, Artificial
  Synthetic
WVRQAPGKGLEWVS

SEQ ID NO: 502 - protein, 14 aa, Artificial
  Synthetic
WVRQAPGKGLEWVA

SEQ ID NO: 503 - protein, 14 aa, Artificial
  Synthetic
WIRQPPGKGLEWIG

SEQ ID NO: 504 - protein, 17 aa, Artificial
  Synthetic
GIIPIFGIANYAQKFQG

SEQ ID NO: 505 - protein, 17 aa, Artificial
  Synthetic
GIIPIFGTANYAQKFQG

SEQ ID NO: 506 - protein, 17 aa, Artificial
  Synthetic
GIAPIFGTAHYAQKFQG

SEQ ID NO: 507 - protein, 17 aa, Artificial
  Synthetic
GIIPIFGTANYAQKFQG

SEQ ID NO: 508 - protein, 16 aa, Artificial
  Synthetic
EIDEVGSTNYNPSLKS

SEQ ID NO: 509 - protein, 16 aa, Artificial
  Synthetic
SIDYSGSTEYNPSLKS

SEQ ID NO: 510 - protein, 16 aa, Artificial
  Synthetic
EIDVDGSTNYNPSLKS

SEQ ID NO: 511 - protein, 17 aa, Artificial
  Synthetic
SISSSSSYIYYADSVKG

SEQ ID NO: 512 - protein, 17 aa, Artificial
  Synthetic
SISSSSAYILYADSVKG

SEQ ID NO: 513 - protein, 17 aa, Artificial
  Synthetic
GISSSGSYIYYADSVKG

SEQ ID NO: 514 - protein, 17 aa, Artificial
  Synthetic
NIKQDGSEKYYVDSVKG

SEQ ID NO: 515 - protein, 17 aa, Artificial
  Synthetic
VIWYDGSNKYYADSVKG

SEQ ID NO: 516 - protein, 16 aa, Artificial
  Synthetic
EIDWSGITNYNPSLKS

SEQ ID NO: 517 - protein, 30 aa, Artificial
  Synthetic
RVTITADESTSTAYMELSSLRSEDTAVYYC

SEQ ID NO: 518 - protein, 30 aa, Artificial
  Synthetic
RVTISVDTSKNQFSLKLSSVTAADTAVYYC

SEQ ID NO: 519 - protein, 30 aa, Artificial
  Synthetic
RFTISRDNAKNSLYLQMNSLRAEDTAVYYC

SEQ ID NO: 520 - protein, 30 aa, Artificial
  Synthetic
RFTISRDNSKNTLYLQMNSLRAEDTAVYYC

SEQ ID NO: 521 - protein, 30 aa, Artificial; identical to SEQ ID NO: 518
  Synthetic

SEQ ID NO: 522 - protein, 17 aa, Artificial
  Synthetic
ARSYYSSRWHYYYYMDV

SEQ ID NO: 523 - protein, 17 aa, Artificial
  Synthetic
ARLGGRGYADEGWYFDL

SEQ ID NO: 524 - protein, 17 aa, Artificial
  Synthetic
ARLPMYYYDSSDLPMDV

SEQ ID NO: 525 - protein, 16 aa, Artificial
  Synthetic
ARDGVYYDSSDLGFDI

SEQ ID NO: 526 - protein, 14 aa, Artificial
  Synthetic
ARDGYYYDTSPYDV

SEQ ID NO: 527 - protein, 19 aa, Artificial
  Synthetic
ARDGGRTSYTATAHNWFDP

SEQ ID NO: 528 - protein, 15 aa, Artificial
  Synthetic
ARDAPWDIYDYYMDV

SEQ ID NO: 529 - protein, 10 aa, Artificial
  Synthetic
ARGAPEYVDV

SEQ ID NO: 530 - protein, 19 aa, Artificial
  Synthetic
ARLPMYYYDSSVSTGSVDV

SEQ ID NO: 531 - protein, 11 aa, Artificial
  Synthetic
WGKGTTVTVSS

SEQ ID NO: 532 - protein, 11 aa, Artificial
  Synthetic
WGRGTLVTVSS

SEQ ID NO: 533 - protein, 11 aa, Artificial
  Synthetic
WGQGTTVTVSS

SEQ ID NO: 534 - protein, 11 aa, Artificial
  Synthetic
WGQGTMVTVSS

SEQ ID NO: 535 - protein, 11 aa, Artificial
  Synthetic
WGQGTLVTVSS

SEQ ID NO: 536 - protein, 11 aa, Artificial
  Synthetic
WGKGTTVTVSS

SEQ ID NO: 537 - protein, 11 aa, Artificial
  Synthetic
WGQGTMVTVSS

SEQ ID NO: 538 - protein, 23 aa, Artificial
  Synthetic
DIQMTQSPSSVSASVGDRVTITC

SEQ ID NO: 539 - protein, 23 aa, Artificial
  Synthetic
EIVLTQSPGTLSLSPGERATLSC

SEQ ID NO: 540 - protein, 23 aa, Artificial
  Synthetic
DIQMTQSPSSLSASVGDRVTITC

SEQ ID NO: 541 - protein, 23 aa, Artificial
  Synthetic
EIVLTQSPATLSLSPGERATLSC

SEQ ID NO: 542 - protein, 23 aa, Artificial
  Synthetic
DIVMTQSPDSLAVSLGERATINC

SEQ ID NO: 543 - protein, 23 aa, Artificial
  Synthetic
DIQMTQSPSSLSASVGDRVTITC

SEQ ID NO: 544 - protein, 23 aa, Artificial
  Synthetic
EIVLTQSPATLSLSPGERATLSC

SEQ ID NO: 545 - protein, 11 aa, Artificial
  Synthetic
RASQGISSWLA

SEQ ID NO: 546 - protein, 12 aa, Artificial
  Synthetic
RASQSVSSSYLA

SEQ ID NO: 547 - protein, 11 aa, Artificial
  Synthetic
QASQDISNYLN

SEQ ID NO: 548 - protein, 11 aa, Artificial
  Synthetic
RASQSVSSYLA

SEQ ID NO: 549 - protein, 17 aa, Artificial
  Synthetic
KSSQSVLFSSNNKNYLA

SEQ ID NO: 550 - protein, 11 aa, Artificial
  Synthetic
RASQSISSYLN

SEQ ID NO: 551 - protein, 11 aa, Artificial
  Synthetic
RASQSVSSYLA

SEQ ID NO: 552 - protein, 15 aa, Artificial
  Synthetic
WYQQKPGKAPKLLIY

SEQ ID NO: 553 - protein, 15 aa, Artificial
  Synthetic
WYQQKPGQAPRLLIY

SEQ ID NO: 554 - protein, 15 aa, Artificial
  Synthetic
WYQQKPGKAPKLLIY

SEQ ID NO: 555 - protein, 15 aa, Artificial
  Synthetic
WYQQKPGQAPRLLIY

SEQ ID NO: 556 - protein, 15 aa, Artificial
  Synthetic
WYQQKPGQPPKLLIY

SEQ ID NO: 557 - protein, 15 aa, Artificial
  Synthetic
WYQQKPGKAPKLLIY

SEQ ID NO: 558 - protein, 15 aa, Artificial
  Synthetic
WYQQKPGQAPRLLIY

SEQ ID NO: 559 - protein, 7 aa, Artificial
  Synthetic
AASNLQS

SEQ ID NO: 560 - protein, 7 aa, Artificial
  Synthetic
GASSRAT

SEQ ID NO: 561 - protein, 7 aa, Artificial
  Synthetic
DASNLAT

SEQ ID NO: 562 - protein, 7 aa, Artificial
  Synthetic
DASNLET

SEQ ID NO: 563 - protein, 7 aa, Artificial
  Synthetic
DASNRAT

SEQ ID NO: 564 - protein, 7 aa, Artificial
  Synthetic
WASTRES

SEQ ID NO: 565 - protein, 7 aa, Artificial
  Synthetic
AASSLQS

SEQ ID NO: 566 - protein, 7 aa, Artificial
  Synthetic
DSSNRAT

SEQ ID NO: 567 - protein, 32 aa, Artificial
  Synthetic
GVPSRFSGSGSGTDFTLTISSLQPEDFATYYC

SEQ ID NO: 568 - protein, 32 aa, Artificial
  Synthetic
GIPDRFSGSGSGTDFTLTISRLEPEDFAVYYC

SEQ ID NO: 569 - protein, 32 aa, Artificial
  Synthetic
GVPSRFSGSGSGTDFTFTISSLQPEDIATYYC

SEQ ID NO: 570 - protein, 32 aa, Artificial
  Synthetic
GIPARFSGSGSGTDFTLTISSLEPEDFAVYYC

SEQ ID NO: 571 - protein, 32 aa, Artificial
  Synthetic
GVPDRFSGSGSGTDFTLTISSLQAEDVAVYYC

SEQ ID NO: 572 - protein, 32 aa, Artificial; identical to SEQ ID NO: 567
  Synthetic

SEQ ID NO: 573 - protein, 32 aa, Artificial; identical to SEQ ID NO: 570
  Synthetic

SEQ ID NO: 574 - protein, 9 aa, Artificial
  Synthetic
QQADDLPLT

SEQ ID NO: 575 - protein, 9 aa, Artificial
  Synthetic
QQYYGSPIT

SEQ ID NO: 576 - protein, 9 aa, Artificial
  Synthetic
QQYDTLPLT

SEQ ID NO: 577 - protein, 9 aa, Artificial
  Synthetic
QQYDDLPIT

SEQ ID NO: 578 - protein, 9 aa, Artificial
  Synthetic
QQRDSFPLT

SEQ ID NO: 579 - protein, 9 aa, Artificial
  Synthetic
QQHASAPPT

SEQ ID NO: 580 - protein, 9 aa, Artificial
  Synthetic
QQSYVPPWT

SEQ ID NO: 581 - protein, 8 aa, Artificial
  Synthetic
QQYSLYPT

SEQ ID NO: 582 - protein, 9 aa, Artificial
  Synthetic
QQDSDHPIT

SEQ ID NO: 583 - protein, 10 aa, Artificial
  Synthetic
FGGGTKVEIK

SEQ ID NO: 584 - protein, 25 aa, Artificial [sequence omitted]

SEQ ID NO: 585 - protein, 25 aa, Artificial [sequence omitted]

SEQ ID NO: 586 - protein, 25 aa, Artificial
  Synthetic
EVQLVESGGGLVKPGGSLRLSCAAS

SEQ ID NO: 587 - protein, 25 aa, Artificial [sequence omitted]

SEQ ID NO: 588 - protein, 25 aa, Artificial
  Synthetic
QVQLVESGGGVVQPGRSLRLSCAAS

SEQ ID NO: 589 - protein, 25 aa, Artificial [sequence omitted]

SEQ ID NO: 590 - protein, 8 aa, Artificial
  Synthetic
GGTFVGYA

SEQ ID NO: 591 - protein, 8 aa, Artificial
  Synthetic
GGTFSAYA

SEQ ID NO: 592 - protein, 8 aa, Artificial
  Synthetic
GGTFESYT

SEQ ID NO: 593 - protein, 8 aa, Artificial
  Synthetic
GGTFSSYA

SEQ ID NO: 594 - protein, 8 aa, Artificial
  Synthetic
GGSFSEYY

SEQ ID NO: 595 - protein, 8 aa, Artificial
  Synthetic
GGSFSRYY

SEQ ID NO: 596 - protein, 8 aa, Artificial
  Synthetic
GGSFSGYY

SEQ ID NO: 597 - protein, 8 aa, Artificial
  Synthetic
GFTFSSYS

SEQ ID NO: 598 - protein, 8 aa, Artificial
  Synthetic
GFTFRSYG

SEQ ID NO: 599 - protein, 8 aa, Artificial
  Synthetic
GFTFSRTG

SEQ ID NO: 600 - protein, 8 aa, Artificial
  Synthetic
GFTFSRYG

SEQ ID NO: 601 - protein, 8 aa, Artificial
  Synthetic
GFTFASYG

SEQ ID NO: 602 - protein, 8 aa, Artificial
  Synthetic
GFTFRSYG

SEQ ID NO: 603 - protein, 8 aa, Artificial
  Synthetic
GFTFSSYG

SEQ ID NO: 604 - protein, 8 aa, Artificial
  Synthetic
GGSFSDYE

SEQ ID NO: 605 - protein, 17 aa, Artificial
  Synthetic
ISWVRQAPGQGLEWMGG

SEQ ID NO: 606 - protein, 17 aa, Artificial
  Synthetic
WAWIRQPPGKGLEWIGE

SEQ ID NO: 607 - protein, 17 aa, Artificial
  Synthetic
WSWIRQPPGKGLEWIGS

SEQ ID NO: 608 - protein, 17 aa, Artificial
  Synthetic
WSWIRQPPGKGLEWIGE

SEQ ID NO: 609 - protein, 17 aa, Artificial
  Synthetic
MNWVRQAPGKGLEWVSS

SEQ ID NO: 610 - protein, 17 aa, Artificial
  Synthetic
MNWVRQAPGKGLEWVSG

SEQ ID NO: 611 - protein, 17 aa, Artificial
  Synthetic
MSWVRQAPGKGLEWVAN

SEQ ID NO: 612 - protein, 17 aa, Artificial
  Synthetic
MHWVRQAPGKGLEWVAV

SEQ ID NO: 613 - protein, 17 aa, Artificial
  Synthetic
WSWIRQPPGKGLEWIGE

SEQ ID NO: 614 - protein, 8 aa, Artificial
  Synthetic
IIPIFGIA

SEQ ID NO: 615 - protein, 8 aa, Artificial
  Synthetic
IIPIFGTA

SEQ ID NO: 616 - protein, 8 aa, Artificial
  Synthetic
IAPIFGTA

SEQ ID NO: 617 - protein, 7 aa, Artificial
  Synthetic
IDEVGST

SEQ ID NO: 618 - protein, 7 aa, Artificial
  Synthetic
IDYSGST

SEQ ID NO: 619 - protein, 7 aa, Artificial
  Synthetic
IDVDGST

SEQ ID NO: 620 - protein, 8 aa, Artificial
  Synthetic
ISSSSSYI

SEQ ID NO: 621 - protein, 8 aa, Artificial
  Synthetic
ISSSSAYI

SEQ ID NO: 622 - protein, 8 aa, Artificial
  Synthetic
ISSSGSYI

SEQ ID NO: 623 - protein, 8 aa, Artificial
  Synthetic
IKQDGSEK

SEQ ID NO: 624 - protein, 8 aa, Artificial
  Synthetic
IWYDGSNK

SEQ ID NO: 625 - protein, 7 aa, Artificial
  Synthetic
IDWSGIT

SEQ ID NO: 626 - protein, 38 aa, Artificial
  Synthetic
NYAQKFQGRVTITADESTSTAYMELSSLRSEDTAVYYC

SEQ ID NO: 627 - protein, 38 aa, Artificial
  Synthetic
HYAQKFQGRVTITADESTSTAYMELSSLRSEDTAVYYC

SEQ ID NO: 628 - protein, 38 aa, Artificial; identical to SEQ ID NO: 626
  Synthetic

SEQ ID NO: 629 - protein, 38 aa, Artificial
  Synthetic
NYNPSLKSRVTISVDTSKNQFSLKLSSVTAADTAVYYC

SEQ ID NO: 630 - protein, 38 aa, Artificial
  Synthetic
EYNPSLKSRVTISVDTSKNQFSLKLSSVTAADTAVYYC

SEQ ID NO: 631 - protein, 38 aa, Artificial
  Synthetic
YYADSVKGRFTISRDNAKNSLYLQMNSLRAEDTAVYYC

SEQ ID NO: 632 - protein, 38 aa, Artificial
  Synthetic
LYADSVKGRFTISRDNAKNSLYLQMNSLRAEDTAVYYC

SEQ ID NO: 633 - protein, 38 aa, Artificial; identical to SEQ ID NO: 631
  Synthetic

SEQ ID NO: 634 - protein, 38 aa, Artificial
  Synthetic
YYVDSVKGRFTISRDNAKNSLYLQMNSLRAEDTAVYYC

SEQ ID NO: 635 - protein, 38 aa, Artificial
  Synthetic
YYADSVKGRFTISRDNSKNTLYLQMNSLRAEDTAVYYC

SEQ ID NO: 636 - protein, 38 aa, Artificial; identical to SEQ ID NO: 629
  Synthetic

SEQ ID NO: 637 - protein, 17 aa, Artificial
  Synthetic
ARSYYSSRWHYYYYMDV

SEQ ID NO: 638 - protein, 17 aa, Artificial
  Synthetic
ARLGGRGYADEGWYFDL

SEQ ID NO: 639 - protein, 17 aa, Artificial
  Synthetic
ARLPMYYYDSSDLPMDV

SEQ ID NO: 640 - protein, 16 aa, Artificial
  Synthetic
ARDGVYYDSSDLGFDI

SEQ ID NO: 641 - protein, 14 aa, Artificial
  Synthetic
ARDGYYYDTSPYDV

SEQ ID NO: 642 - protein, 19 aa, Artificial
  Synthetic
ARDGGRTSYTATAHNWFDP

SEQ ID NO: 643 - protein, 15 aa, Artificial
  Synthetic
ARDAPWDIYDYYMDV

SEQ ID NO: 644 - protein, 10 aa, Artificial
  Synthetic
ARGAPEYVDV

SEQ ID NO: 645 - protein, 19 aa, Artificial
  Synthetic
ARLPMYYYDSSVSTGSVDV

SEQ ID NO: 646 - protein, 11 aa, Artificial
  Synthetic
WGKGTTVTVSS

SEQ ID NO: 647 - protein, 11 aa, Artificial
  Synthetic
WGRGTLVTVSS

SEQ ID NO: 648 - protein, 11 aa, Artificial
  Synthetic
WGQGTTVTVSS

SEQ ID NO: 649 - protein, 11 aa, Artificial
  Synthetic
WGQGTMVTVSS

SEQ ID NO: 650 - protein, 11 aa, Artificial
  Synthetic
WGQGTLVTVSS

SEQ ID NO: 651 - protein, 11 aa, Artificial
  Synthetic
WGKGTTVTVSS

SEQ ID NO: 652 - protein, 11 aa, Artificial
  Synthetic
WGQGTMVTVSS

SEQ ID NO: 653 - protein, 26 aa, Artificial [sequence omitted]

SEQ ID NO: 654 - protein, 26 aa, Artificial [sequence omitted]

SEQ ID NO: 655 - protein, 26 aa, Artificial
  Synthetic
DIQMTQSPSSLSASVGDRVTITCQAS

SEQ ID NO: 656 - protein, 25 aa, Artificial
  Synthetic
EIVLTQSPATLSLSPGERATLSCRA

SEQ ID NO: 657 - protein, 26 aa, Artificial
  Synthetic
DIVMTQSPDSLAVSLGERATINCKSS

SEQ ID NO: 658 - protein, 26 aa, Artificial [sequence omitted]

SEQ ID NO: 659 - protein, 26 aa, Artificial [sequence omitted]

SEQ ID NO: 660 - protein, 6 aa, Artificial
  Synthetic
QGISSW

SEQ ID NO: 661 - protein, 7 aa, Artificial
  Synthetic
QSVSSSY

SEQ ID NO: 662 - protein, 6 aa, Artificial
  Synthetic
QDISNY

SEQ ID NO: 663 - protein, 7 aa, Artificial
  Synthetic
SQSVSSY

SEQ ID NO: 664 - protein, 12 aa, Artificial
  Synthetic
QSVLFSSNNKNY

SEQ ID NO: 665 - protein, 6 aa, Artificial
  Synthetic
QSISSY

SEQ ID NO: 666 - protein, 6 aa, Artificial
  Synthetic
QSVSSY

SEQ ID NO: 667 - protein, 17 aa, Artificial
  Synthetic
LAWYQQKPGKAPKLLIY

SEQ ID NO: 668 - protein, 17 aa, Artificial
  Synthetic
LAWYQQKPGQAPRLLIY

SEQ ID NO: 669 - protein, 17 aa, Artificial
  Synthetic
LNWYQQKPGKAPKLLIY

SEQ ID NO: 670 - protein, 17 aa, Artificial
  Synthetic
LAWYQQKPGQAPRLLIY

SEQ ID NO: 671 - protein, 17 aa, Artificial
  Synthetic
LAWYQQKPGQPPKLLIY

SEQ ID NO: 672 - protein, 17 aa, Artificial
  Synthetic
LNWYQQKPGKAPKLLIY

SEQ ID NO: 673 - protein, 17 aa, Artificial
  Synthetic
LAWYQQKPGQAPRLLIY

SEQ ID NO: 674 - protein, 3 aa, Artificial
  Synthetic
AAS

SEQ ID NO: 675 - protein, 3 aa, Artificial
  Synthetic
GAS

SEQ ID NO: 676 - protein, 3 aa, Artificial
  Synthetic
DAS

SEQ ID NO: 677 - protein, 3 aa, Artificial
  Synthetic
WAS

SEQ ID NO: 678 - protein, 3 aa, Artificial
  Synthetic
AAS

SEQ ID NO: 679 - protein, 3 aa, Artificial
  Synthetic
DSS

SEQ ID NO: 680 - protein, 36 aa, Artificial
  Synthetic
NLQSGVPSRFSGSGSGTDFTLTISSLQPEDFATYYC

SEQ ID NO: 681 - protein, 36 aa, Artificial [sequence omitted]

SEQ ID NO: 682 - protein, 36 aa, Artificial
  Synthetic
NLATGVPSRFSGSGSGTDFTFTISSLQPEDIATYYC

SEQ ID NO: 683 - protein, 36 aa, Artificial
  Synthetic
NLETGVPSRFSGSGSGTDFTFTISSLQPEDIATYYC

SEQ ID NO: 684 - protein, 36 aa, Artificial [sequence omitted]

SEQ ID NO: 685 - protein, 36 aa, Artificial
  Synthetic
TRESGVPDRFSGSGSGTDFTLTISSLQAEDVAVYYC

SEQ ID NO: 686 - protein, 36 aa, Artificial
  Synthetic
SLQSGVPSRFSGSGSGTDFTLTISSLQPEDFATYYC

SEQ ID NO: 687 - protein, 36 aa, Artificial [sequence omitted]

SEQ ID NO: 688 - protein, 9 aa, Artificial
  Synthetic
QQADDLPLT

SEQ ID NO: 689 - protein, 9 aa, Artificial
  Synthetic
QQYYGSPIT

SEQ ID NO: 690 - protein, 9 aa, Artificial
  Synthetic
QQYDTLPLT

SEQ ID NO: 691 - protein, 9 aa, Artificial
  Synthetic
QQYDDLPIT

SEQ ID NO: 692 - protein, 9 aa, Artificial
  Synthetic
QQRDSFPLT

SEQ ID NO: 693 - protein, 9 aa, Artificial
  Synthetic
QQHASAPPT

SEQ ID NO: 694 - protein, 9 aa, Artificial
  Synthetic
QQSYVPPWT

SEQ ID NO: 695 - protein, 8 aa, Artificial
  Synthetic
QQYSLYPT

SEQ ID NO: 696 - protein, 9 aa, Artificial
  Synthetic
QQDSDHPIT

SEQ ID NO: 697 - protein, 10 aa, Artificial
  Synthetic
FGGGTKVEIK

SEQ ID NO: 698 - protein, 229 aa, Artificial
  Synthetic
MTPQLLLALVLWASCPPCSGRKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 699 - protein, 243 aa, Artificial
  Synthetic
MGQTAGDLGWRLSLLLLPLLLVQAGVWGFPRPPGRPQLSLQELRREFTVSLHLARKLLSEVRGQAHRFAESHLPGVNLYLLPLGEQLPDVSLTFQAWRRLSDPERLCFISTTLQPFHALLGGLGTQGRWTNMERMQLWAMRLDLRDLQRHLRFQVLAAGFNLPEEEEEEEEEEEEERKGLLPGALGSALQGPAQVSWPQLLSTYRLLHSLELVLSRAVRELLLLSKAGHSVWPLGFPTLSPQP

SEQ ID NO: 700 - protein, 636 aa, Artificial
  Synthetic
MRGGRGAPFWLWPLPKLALLPLLWVLFQRTRPQGSAGPLQCYGVGPLGDLNCSWEPLGDLGAPSELHLQSQKYRSNKTQTVAVAAGRSWVAIPREQLTMSDKLLVWGTKAGQPLWPPVFVNLETQMKPNAPRLGPDVDFSEDDPLEATVHWAPPTWPSHKVLICQFHYRRCQEAAWTLLEPELKTIPLTPVEIQDLELATGYKVYGRCRMEKEEDLWGEWSPILSFQTPPSAPKDVWVSGNLCGTPGGEEPLLLWKAPGPCVQVSYKVWFWVGGRELSPEGITCCCSLIPSGAEWARVSAVNATSWEPLTNLSLVCLDSASAPRSVAVSSIAGSTELLVTWQPGPGEPLEHVVDWARDGDPLEKLNWVRLPPGNLSALLPGNFTVGVPYRITVTAVSASGLASASSVWGFREELAPLVGPTLWRLQDAPPGTPAIAWGEVPRHQLRGHLTHYTLCAQSGTSPSVCMNVSGNTQSVTLPDLPWGPCELWVTASTIAGQGPPGPILRLHLPDNTLRWKVLPGILFLWGLFLLGCGLSLATSGRCYHLRHKVLPRWVWEKVPDPANSSSGQPHMEQVPEAQPLGDLPILEVEEMEPPPVMESSQPAQATAPLDSGYEKHFLPTPEELGLLGPPRPQVLA

SEQ ID NO: 701 - protein, 918 aa, Artificial
  Synthetic
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 702 - protein, 232 aa, Artificial
  Synthetic
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 703 - protein, 229 aa, Artificial
  Synthetic
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 704 - protein, 229 aa, Artificial
  Synthetic
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 705 - protein, 229 aa, Artificial
  Synthetic
ESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 706 - protein, 10 aa, Artificial
  Synthetic
GGSISSGGYY

SEQ ID NO: 707 - protein, 7 aa, Artificial
  Synthetic
IYYSGST

SEQ ID NO: 708 - protein, 12 aa, Artificial
  Synthetic
ARDGVYQPGAYY

SEQ ID NO: 709 - protein, 11 aa, Artificial
  Synthetic
GSISSGGYYWS

SEQ ID NO: 710 - protein, 16 aa, Artificial
  Synthetic
NIYYSGSTYYNPSLKS

SEQ ID NO: 711 - protein, 12 aa, Artificial
  Synthetic
ARDGVYQPGAYY

SEQ ID NO: 712 - protein, 120 aa, Artificial
  Synthetic
QVQLQESGPGLVKPSQTLSLTCTVSGGSISSGGYYWSWIRQHPGKGLEWIGNIYYSGSTYYNPSLKSRVTISVDTSKNQFSLKLSSVTAADTAVYYCARDGVYQPGAYYWGQGTLVTVSS

SEQ ID NO: 713 - DNA, 360 bp, Artificial
  Synthetic
caggtgcagctgcaggagtcgggcccaggactggtgaagccttcacagaccctgtccctcacctgtactgtctctggtggctccatcagcagtggtggttactactggagctggatccgccagcacccagggaagggcctggagtggattgggaacatctattacagtgggagcacctactacaacccgtccctcaagagtcgagttaccatatcagtagacacgtctaagaaccagttctccctgaagctgagttctgtgaccgccgcagacacggcggtgtactactgcgccagagatggtgtgtaccaacctggtgcctactattggggacagggtacattggtcaccgtctcctca

SEQ ID NO: 714 - protein, 6 aa, Artificial
  Synthetic
QGISSW

SEQ ID NO: 715 - protein, 3 aa, Artificial
  Synthetic
GAS

SEQ ID NO: 716 - protein, 9 aa, Artificial
  Synthetic
QQGVSFPIT

SEQ ID NO: 717 - protein, 11 aa, Artificial
  Synthetic
RASQGISSWLA

SEQ ID NO: 718 - protein, 7 aa, Artificial
  Synthetic
GASSLQS

SEQ ID NO: 719 - protein, 9 aa, Artificial
  Synthetic
QQGVSFPIT

SEQ ID NO: 720 - protein, 107 aa, Artificial
  Synthetic
DIQLTQSPSSVSASVGDRVTITCRASQGISSWLAWYQQKPGKAPKLLIYGASSLQSGVPSRFSGSGSGTDFTLTISSLQPEDFATYYCQQGVSFPITFGGGTKVEIK

SEQ ID NO: 721 - DNA, 321 bp, Artificial
  Synthetic
gacatccagttgacccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttgcaaagtggggtcccatcaaggttcagcggcagtggatctgggacagatttcactctcaccatcagcagcctgcagcctgaagattttgcaacttattactgtcagcagggagtcagtttccctatcacttttggcggagggaccaaggttgagatcaaa

SEQ ID NO: 722 - protein, 450 aa, Artificial
  Synthetic
QVQLQESGPGLVKPSQTLSLTCTVSGGSISSGGYYWSWIRQHPGKGLEWIGNIYYSGSTYYNPSLKSRVTISVDTSKNQFSLKLSSVTAADTAVYYCARDGVYQPGAYYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 723 - DNA, 1350 bp, Artificial
  Synthetic
caggtgcagctgcaggagtcgggcccaggactggtgaagccttcacagaccctgtccctcacctgtactgtctctggtggctccatcagcagtggtggttactactggagctggatccgccagcacccagggaagggcctggagtggattgggaacatctattacagtgggagcacctactacaacccgtccctcaagagtcgagttaccatatcagtagacacgtctaagaaccagttctccctgaagctgagttctgtgaccgccgcagacacggcggtgtactactgcgccagagatggtgtgtaccaacctggtgcctactattggggacagggtacattggtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 724 - protein, 214 aa, Artificial
  Synthetic
DIQLTQSPSSVSASVGDRVTITCRASQGISSWLAWYQQKPGKAPKLLIYGASSLQSGVPSRFSGSGSGTDFTLTISSLQPEDFATYYCQQGVSFPITFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 725 - DNA, 642 bp, Artificial
  Synthetic
gacatccagttgacccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttgcaaagtggggtcccatcaaggttcagcggcagtggatctgggacagatttcactctcaccatcagcagcctgcagcctgaagattttgcaacttattactgtcagcagggagtcagtttccctatcacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 726 - protein, 446 aa, Artificial
  Synthetic
QVQLQESGPGLVKPSQTLSLTCTVSGGSISSGGYYWSWIRQHPGKGLEWIGNIYYSGSTYYNPSLKSRVTISVDTSKNQFSLKLSSVTAADTAVYYCARDGVYQPGAYYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 727 - DNA, 1338 bp, Artificial
  Synthetic
caggtgcagctgcaggagtcgggcccaggactggtgaagccttcacagaccctgtccctcacctgtactgtctctggtggctccatcagcagtggtggttactactggagctggatccgccagcacccagggaagggcctggagtggattgggaacatctattacagtgggagcacctactacaacccgtccctcaagagtcgagttaccatatcagtagacacgtctaagaaccagttctccctgaagctgagttctgtgaccgccgcagacacggcggtgtactactgcgccagagatggtgtgtaccaacctggtgcctactattggggacagggtacattggtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 728 - protein, 8 aa, Artificial
  Synthetic
GGTFSSYA

SEQ ID NO: 729 - protein, 8 aa, Artificial
  Synthetic
IIPIFGTA

SEQ ID NO: 730 - protein, 17 aa, Artificial
  Synthetic
ARSYYSSRWHYYYYMDV

SEQ ID NO: 731 - protein, 9 aa, Artificial
  Synthetic
GTFSSYAIS

SEQ ID NO: 732 - protein, 17 aa, Artificial
  Synthetic
GIIPIFGTANYAQKFQG

SEQ ID NO: 733 - protein, 17 aa, Artificial
  Synthetic
ARSYYSSRWHYYYYMDV

SEQ ID NO: 734 - protein, 124 aa, Artificial
  Synthetic
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSYYSSRWHYYYYMDVWGKGTTVTVSS

SEQ ID NO: 735 - DNA, 372 bp, Artificial
  Synthetic
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagatcttactactccagccgatggcactactactactacatggacgtgtggggcaagggtacaactgtcaccgtctcctca

SEQ ID NO: 736 - protein, 6 aa, Artificial
  Synthetic
QGISSW

SEQ ID NO: 737 - protein, 3 aa, Artificial
  Synthetic
AAS

SEQ ID NO: 738 - protein, 9 aa, Artificial
  Synthetic
QQADDLPLT

SEQ ID NO: 739 - protein, 11 aa, Artificial
  Synthetic
RASQGISSWLA

SEQ ID NO: 740 - protein, 7 aa, Artificial
  Synthetic
AASNLQS

SEQ ID NO: 741 - protein, 9 aa, Artificial
  Synthetic
QQADDLPLT

SEQ ID NO: 742 - protein, 107 aa, Artificial; identical to SEQ ID NO: 199
  Synthetic

SEQ ID NO: 743 - DNA, 321 bp, Artificial; identical to SEQ ID NO: 354
  Synthetic

SEQ ID NO: 744 - protein, 454 aa, Artificial
  Synthetic
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSYYSSRWHYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 745 - DNA, 1362 bp, Artificial
  Synthetic
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagatcttactactccagccgatggcactactactactacatggacgtgtggggcaagggtacaactgtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 746 - protein, 214 aa, Artificial; identical to SEQ ID NO: 203
  Synthetic

SEQ ID NO: 747 - DNA, 642 bp, Artificial; identical to SEQ ID NO: 358
  Synthetic

SEQ ID NO: 748 - protein, 450 aa, Artificial
  Synthetic
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSYYSSRWHYYYYMDVWGKGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 749 - DNA, 1350 bp, Artificial
  Synthetic
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagatcttactactccagccgatggcactactactactacatggacgtgtggggcaagggtacaactgtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 750 - protein, 8 aa, Artificial
  Synthetic
GGSISSYY

SEQ ID NO: 751 - protein, 7 aa, Artificial
  Synthetic
IYYSGST

SEQ ID NO: 752 - protein, 13 aa, Artificial
  Synthetic
AREVDRDDVAFDI

SEQ ID NO: 753 - protein, 9 aa, Artificial
  Synthetic
GSISSYYWS

SEQ ID NO: 754 - protein, 16 aa, Artificial
  Synthetic
SIYYSGSTNYNPSLKS

SEQ ID NO: 755 - protein, 13 aa, Artificial
  Synthetic
AREVDRDDVAFDI

SEQ ID NO: 756 - protein, 119 aa, Artificial
  Synthetic
QVQLQESGPGLVKPSETLSLTCTVSGGSISSYYWSWIRQPPGKGLEWIGSIYYSGSTNYNPSLKSRVTISVDTSKNQFSLKLSSVTAADTAVYYCAREVDRDDVAFDIWGQGTMVTVSS

SEQ ID NO: 757 - DNA, 357 bp, Artificial
  Synthetic
caggtgcagctgcaggagtcgggcccaggactggtgaagccttcggagaccctgtccctcacctgcactgtctctggtggctccatcagtagttactactggagctggatccggcagcccccagggaagggactggagtggattgggtcaatctattacagtgggagcaccaactacaacccctccctcaagagtcgagtcaccatatcagtagacacgtccaagaaccagttctccctgaagctgagttctgtgaccgccgcagacacggcggtgtactactgcgccagagaggtggacagagatgatgtagcattcgacatatggggtcagggtacaatggtcaccgtctcctca

SEQ ID NO: 758 - protein, 6 aa, Artificial
  Synthetic
QDISNY

SEQ ID NO: 759 - protein, 3 aa, Artificial
  Synthetic
DAS

SEQ ID NO: 760 - protein, 9 aa, Artificial
  Synthetic
QQYVLFPIT

SEQ ID NO: 761 - protein, 11 aa, Artificial
  Synthetic
QASQDISNYLN

SEQ ID NO: 762 - protein, 7 aa, Artificial
  Synthetic
DASNLET

SEQ ID NO: 763 - protein, 9 aa, Artificial
  Synthetic
QQYVLFPIT

SEQ ID NO: 764 - protein, 107 aa, Artificial
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYVLFPITFGGGTKVEIK

SEQ ID NO: 765 - DNA, 321 bp, Artificial
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtacgtcctcttccctatcacttttggcggagggaccaaggttgagatcaaa

SEQ ID NO: 766 - protein, 449 aa, Artificial
  Synthetic
QVQLQESGPGLVKPSETLSLTCTVSGGSISSYYWSWIRQPPGKGLEWIGSIYYSGSTNYNPSLKSRVTISVDTSKNQFSLKLSSVTAADTAVYYCAREVDRDDVAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 767 - DNA, 1347 bp, Artificial
  Synthetic
caggtgcagctgcaggagtcgggcccaggactggtgaagccttcggagaccctgtccctcacctgcactgtctctggtggctccatcagtagttactactggagctggatccggcagcccccagggaagggactggagtggattgggtcaatctattacagtgggagcaccaactacaacccctccctcaagagtcgagtcaccatatcagtagacacgtccaagaaccagttctccctgaagctgagttctgtgaccgccgcagacacggcggtgtactactgcgccagagaggtggacagagatgatgtagcattcgacatatggggtcagggtacaatggtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 768 - protein, 214 aa, Artificial
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYVLFPITFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 769 - DNA, 642 bp, Artificial
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtacgtcctcttccctatcacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 770 - protein, 445 aa, Artificial
  Synthetic
QVQLQESGPGLVKPSETLSLTCTVSGGSISSYYWSWIRQPPGKGLEWIGSIYYSGSTNYNPSLKSRVTISVDTSKNQFSLKLSSVTAADTAVYYCAREVDRDDVAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 771 - DNA, 1335 bp, Artificial
  Synthetic
caggtgcagctgcaggagtcgggcccaggactggtgaagccttcggagaccctgtccctcacctgcactgtctctggtggctccatcagtagttactactggagctggatccggcagcccccagggaagggactggagtggattgggtcaatctattacagtgggagcaccaactacaacccctccctcaagagtcgagtcaccatatcagtagacacgtccaagaaccagttctccctgaagctgagttctgtgaccgccgcagacacggcggtgtactactgcgccagagaggtggacagagatgatgtagcattcgacatatggggtcagggtacaatggtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 772 - protein, 10 aa, Artificial
  Synthetic
GGSISSSSYY

SEQ ID NO: 773 - protein, 7 aa, Artificial
  Synthetic
ISYSGST

SEQ ID NO: 774 - protein, 12 aa, Artificial
  Synthetic
AREEYSFSYLDY

SEQ ID NO: 775 - protein, 11 aa, Artificial
  Synthetic
GSISSSSYYWG

SEQ ID NO: 776 - protein, 16 aa, Artificial
  Synthetic
SISYSGSTYYNPSLKS

SEQ ID NO: 777 - protein, 12 aa, Artificial
  Synthetic
AREEYSFSYLDY

SEQ ID NO: 778 - protein, 120 aa, Artificial
  Synthetic
QLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCAREEYSFSYLDYWGQGTTVTVSS

SEQ ID NO: 779 - DNA, 360 bp, Artificial
  Synthetic
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctcctatagtgggagcacctactacaacccgtccctcaagagtcgagtcaccatatccgtagacacgtccaagaaccagttctccctgaagctgagttctgtgaccgccgcagacacggcggtgtactactgcgccagagaggaatatagcttcagctacttagattactggggacagggaacaactgtcaccgtctcctca

SEQ ID NO: 780 - protein, 6 aa, Artificial
  Synthetic
QGISSW

SEQ ID NO: 781 - protein, 3 aa, Artificial
  Synthetic
AAS

SEQ ID NO: 782 - protein, 9 aa, Artificial
  Synthetic
QQALLFPPT

SEQ ID NO: 783 - protein, 11 aa, Artificial
  Synthetic
RASQGISSWLA

SEQ ID NO: 784 - protein, 7 aa, Artificial
  Synthetic
AASNLQS

SEQ ID NO: 785 - protein, 9 aa, Artificial
  Synthetic
QQALLFPPT

SEQ ID NO: 786 - protein, 107 aa, Artificial
  Synthetic
DIQMTQSPSSVSASVGDRVTITCRASQGISSWLAWYQQKPGKAPKLLIYAASNLQSGVPSRFSGSGSGTDFTLTISSLQPEDFATYYCQQALLFPPTFGGGTKVEIK

SEQ ID NO: 787 - DNA, 321 bp, Artificial
  Synthetic
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccaatttgcaaagtggggtcccatcaaggttcagcggcagtggatctgggacagatttcactctcaccatcagcagcctgcagcctgaagattttgcaacttattactgtcagcaggcactcctcttccctcctacttttggcggagggaccaaggttgagatcaaa

SEQ ID NO: 788 - protein, 450 aa, Artificial
  Synthetic
QLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCAREEYSFSYLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 789 - DNA, 1350 bp, Artificial
  Synthetic
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctcctatagtgggagcacctactacaacccgtccctcaagagtcgagtcaccatatccgtagacacgtccaagaaccagttctccctgaagctgagttctgtgaccgccgcagacacggcggtgtactactgcgccagagaggaatatagcttcagctacttagattactggggacagggaacaactgtcaccgtctcctcagcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 790 - protein, 214 aa, Artificial
  Synthetic
DIQMTQSPSSVSASVGDRVTITCRASQGISSWLAWYQQKPGKAPKLLIYAASNLQSGVPSRFSGSGSGTDFTLTISSLQPEDFATYYCQQALLFPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 791 - DNA, 642 bp, Artificial
  Synthetic
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccaatttgcaaagtggggtcccatcaaggttcagcggcagtggatctgggacagatttcactctcaccatcagcagcctgcagcctgaagattttgcaacttattactgtcagcaggcactcctcttccctcctacttttggcggagggaccaaggttgagatcaaacgtacggtggccgctccctccgtgttcatcttcccaccctccgacgagcagctgaagtccggcaccgcctccgtcgtgtgcctgctgaacaacttctaccctcgcgaggccaaagtgcagtggaaagtggacaacgccctgcagtccggcaactcccaggaatccgtcaccgagcaggactccaaggacagcacctactccctgtcctccaccctgaccctgtccaaggccgactacgagaagcacaaagtgtacgcctgcgaagtgacccaccagggcctgtccagccccgtgaccaagtccttcaaccggggcgagtgc

SEQ ID NO: 792 - protein, 446 aa, Artificial
  Synthetic
QLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCAREEYSFSYLDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 793 - DNA, 1338 bp, Artificial
  Synthetic
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctcctatagtgggagcacctactacaacccgtccctcaagagtcgagtcaccatatccgtagacacgtccaagaaccagttctccctgaagctgagttctgtgaccgccgcagacacggcggtgtactactgcgccagagaggaatatagcttcagctacttagattactggggacagggaacaactgtcaccgtctcctcagcttccaccaagggcccctccgtgttccctctggccccttgctcccggtccacctccgagtctaccgccgctctgggctgcctcgtgaaggactacttccccgagcccgtgaccgtgtcctggaactctggcgccctgacctccggcgtgcacaccttccctgccgtgctgcagtcctccggcctgtactccctgtccagcgtcgtgaccgtgccctcctccagcctgggcaccaagacctacacctgtaacgtggaccacaagccctccaacaccaaagtggacaagcgggtggaatctaagtacggccctccctgcccttcctgccctgcccctgagttcctgggcggaccttccgtgttcctgttccctccaaagcccaaggacaccctgatgatctcccggacccctgaagtgacctgcgtggtggtggacgtgtcccaggaagatcccgaagtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtgtccaacaagggcctgccctccagcatcgaaaagaccatctccaaggccaagggccagccccgcgagccccaagtgtacaccctgcctcccagccaggaagagatgaccaagaatcaagtgtccctgacttgtctggtcaagggcttctacccctccgatatcgccgtggagtgggagtccaacggccagcccgagaacaactacaagaccacccctcccgtgctggactccgacggctccttcttcctgtactctcggctgaccgtggacaagtcccggtggcaggaaggcaacgtcttctcctgctccgtgatgcacgaggccctgcacaaccactacacccagaagtccctgtccctgtctctgggc

SEQ ID NO: 794 - protein, 121 aa, Artificial
  Synthetic
QVQLQQSGPGLVKPSQTLSLTCAISGYSVSSNNAAWNWIRQSPSRGLEWLGRTYYRSKWYNDYALSVKSRVTINPDTSKNQFSLHLNPVTPEDTALYFCARGLPMVPFDSWGQGTLVTVSS

SEQ ID NO: 795 - DNA, 363 bp, Artificial
  Synthetic
caggtacagctgcagcagtcaggtccaggactggtgaagccctcgcagaccctctcactcacctgtgccatctccgggtacagtgtctctagcaacaacgctgcttggaactggatcaggcagtccccatcgagaggccttgagtggctgggaaggacatactacaggtccaagtggtataatgattatgcactatctgtgaaaagtcgagtgaccatcaatccagatacatccaagaaccagttctccctgcacctgaaccctgtgactcccgaggacacggctttgtatttctgtgcaagaggacttcctatggtcccttttgactcctggggccagggaaccctggtcaccgtctcctca

SEQ ID NO: 796 - protein, 108 aa, Artificial
  Synthetic
DIQMTQSPSTLSASVGDRVTITCRASQSISSWLAWYQQKPGKAPKLLIYKASSLESGVPSRFSGSGSGTEFTLTISSLQPDDFATYFCQQYDSFSMYTFGQGTKLEIK

SEQ ID NO: 797 - DNA, 324 bp, Artificial
  Synthetic
gacatccagatgacccaatctccttccaccctgtctgcatctgtaggagacagagtcaccatcacttgccgggccagtcagagtattagtagctggttggcctggtatcagcagaaaccagggaaagcccctaagctcctgatctataaggcgtcgagtttagaaagtggggtcccatcaaggttcagcggcagtggatctgggacagaattcactctcaccatcagtagcctgcagcctgatgattttgcaacttatttctgccaacagtatgatagtttttccatgtacacttttggccaggggaccaagctggagatcaaa

SEQ ID NO: 798 - protein, 107 aa, Artificial [sequence omitted]

SEQ ID NO: 799 - protein, 327 aa, Artificial
  Synthetic
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 800 - protein, 327 aa, Artificial
  Synthetic
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 801 - protein, 330 aa, Artificial [sequence omitted]

SEQ ID NO: 802 - protein, 7 aa, Artificial
  Synthetic
SNNAAWN

SEQ ID NO: 803 - protein, 18 aa, Artificial
  Synthetic
RTYYRSKWYNDYALSVKS

SEQ ID NO: 804 - protein, 9 aa, Artificial
  Synthetic
GLPMVPFDS

SEQ ID NO: 805 - protein, 11 aa, Artificial
  Synthetic
RASQSISSWLA

SEQ ID NO: 806 - protein, 7 aa, Artificial
  Synthetic
KASSLES

SEQ ID NO: 807 - protein, 10 aa, Artificial
  Synthetic
QQYDSFSMYT

What is claimed is:

1. A monoclonal antibody that specifically binds human IL-27, or antigen binding portion thereof, wherein the antibody or antigen binding portion thereof comprises heavy and light chain CDRs selected from the group consisting of:

(i) heavy chain CDR1, CDR2 and CDR3 sequences set forth in SEQ ID NOs: 706, 707 and 708, respectively, and light chain CDR1, CDR2 and CDR3 sequences set forth in SEQ ID NOs: 714, 715 and 716, respectively;

(ii) heavy chain CDR1, CDR2 and CDR3 sequences set forth in SEQ ID NOs: 728, 729 and 730, respectively, and light chain CDR1, CDR2 and CDR3 sequences set forth in SEQ ID NOs: 736, 737 and 738, respectively;

(iii) heavy chain CDR1, CDR2 and CDR3 sequences set forth in SEQ ID NOs: 750, 751 and 752, respectively, and light chain CDR1, CDR2 and CDR3 sequences set forth in SEQ ID NOs: 758, 759 and 760, respectively;

(iv) heavy chain CDR1, CDR2 and CDR3 sequences set forth in SEQ ID NOs: 772, 773 and 774, respectively, and light chain CDR1, CDR2 and CDR3 sequences set forth in SEQ ID NOs: 780, 781 and 782, respectively;

(v) heavy chain CDR1, CDR2 and CDR3 sequences set forth in SEQ ID NOs: 709, 710 and 711, respectively, and light chain CDR1, CDR2 and CDR3 sequences set forth in SEQ ID NOs: 717, 718 and 719, respectively;

(vi) heavy chain CDR1, CDR2 and CDR3 sequences set forth in SEQ ID NOs: 731, 732 and 733, respectively, and light chain CDR1, CDR2 and CDR3 sequences set forth in SEQ ID NOs: 739, 740 and 741, respectively;

(vii) heavy chain CDR1, CDR2 and CDR3 sequences set forth in SEQ ID NOs: 753, 754 and 755, respectively, and light chain CDR1, CDR2 and CDR3 sequences set forth in SEQ ID NOs: 761, 762 and 763, respectively; and (viii) heavy chain CDR1, CDR2 and CDR3 sequences set forth in SEQ ID NOs: 775, 776 and 777, respectively, and light chain CDR1, CDR2 and CDR3 sequences set forth in SEQ ID NOs: 783, 784 and 785, respectively.

2. The monoclonal antibody, or antigen binding portion thereof, of claim 1, wherein the antibody or antigen binding portion thereof comprises a heavy chain variable region and a light chain variable region comprising amino acid sequences at least 90% identical to the amino acid sequences selected from the group consisting of:
(i) SEQ ID NO: 712 and 720, respectively;
(ii) SEQ ID NO: 734 and 742, respectively;
(iii) SEQ ID NO: 756 and 764, respectively; and
(iv) SEQ ID NO: 778 and 786, respectively.

3. The monoclonal antibody, or antigen binding portion thereof, of claim 1 wherein:
(i) the antibody, or antigen binding portion thereof, antagonizes IL-27;
(ii) the antibody, or antigen binding portion thereof, inhibits or reduces STAT1 and/or STAT3 phosphorylation in a cell, optionally wherein the cell is an immune cell or a cancer cell;
(iii) the antibody, or antigen binding portion thereof, inhibits or reduces inhibition of CD161 expression in a cell;
(iv) the antibody or antigen binding portion thereof inhibits or reduces PD-L1 and/or TIM-3 expression in a cell;
(v) the antibody, or antigen binding portion thereof, induces or enhances the PD-1-mediated secretion of one or more cytokines from a cell, optionally wherein the one or more cytokines is IFNγ, IL-17, TNFα and/or IL-6; or
(vi) any combination of (i)-(v).

4. The monoclonal antibody, or antigen binding portion thereof, of claim 1, wherein the antibody comprises (i) a wild type IgG1 heavy chain constant region, (ii) a wild type IgG4 heavy chain constant region, (iii) a mutant IgG1 heavy chain constant region, or (iv) a mutant IgG4 heavy chain constant region.

5. The monoclonal antibody, or antigen binding portion thereof, of claim 4, wherein the mutant IgG4 heavy chain constant region comprises any one of the substitutions S228P, L235E, L235A, or a combination thereof, according to EU numbering.

6. A pharmaceutical composition comprising the monoclonal antibody, or antigen binding portion thereof, of claim 1, and a pharmaceutically acceptable carrier.

7. A method of detecting IL-27, in a sample from a subject, comprising (a) contacting a sample from the subject with a detection antibody under conditions to permit the detection antibody to form a detection antibody-IL-27 complex, if IL-27 is present in the sample; and (b) detecting the presence of the complex, if any, produced in step (a); wherein the detection antibody comprises the antibody, or antigen binding portion thereof, of claim 1.

8. The method of claim 7, further comprising contacting the sample with a capture antibody to produce a complex comprising IL-27 and the capture antibody, if IL-27 is present in the sample.

9. The method of claim 8, wherein the capture antibody comprises:
(i) a heavy CDR1 comprising the amino acid sequence set forth in SEQ ID NO: 23,
(ii) a heavy CDR2 comprising the amino acid sequence set forth in SEQ ID NO: 24,
(iii) a heavy CDR3 comprising the amino acid sequence set forth in SEQ ID NO: 25,
(iv) a light CDR1 comprising the amino acid sequence set forth in SEQ ID NO: 26,
(v) a light CDR2 comprising the amino acid sequence set forth in SEQ ID NO: 27, and
(vi) a light CDR3 comprising the amino acid sequence set forth in SEQ ID NO: 28.

10. The method of claim 7, wherein the detection antibody is coupled to a detectable label.

11. The method of claim 8, wherein the capture antibody is immobilized on a solid support.

12. The method of claim 8, wherein the sample is contacted with the capture antibody before the detection antibody.

13. The method of claim 7, wherein the sample is a body fluid sample.

14. The method of claim 13, wherein the fluid sample is blood, serum, plasma, cell lysates or tissue lysates.

15. The monoclonal antibody, or antigen binding portion thereof, of claim 1, wherein the heavy chain CDR1, CDR2 and CDR3 sequences are set forth in SEQ ID NOs: 706, 707 and 708, respectively, and the light chain CDR1, CDR2 and CDR3 sequences are set forth in SEQ ID NOs: 714, 715 and 716, respectively.

16. The monoclonal antibody, or antigen binding portion thereof, of claim 1, wherein the antibody or antigen binding portion thereof comprises a heavy chain variable region and a light chain variable region comprising amino acid sequences at least 90% identical to SEQ ID NOs: 712 and 720, respectively.

17. The monoclonal antibody, or antigen binding portion thereof, of claim 1, wherein the antibody or antigen binding portion thereof comprises a heavy chain and a light chain comprising amino acid sequences at least 90% identical to the amino acid sequences selected from the group consisting of:
(i) SEQ ID NO: 722 and 724, respectively;
(ii) SEQ ID NO: 744 and 746, respectively;
(iii) SEQ ID NO: 766 and 768, respectively;
(iv) SEQ ID NO: 788 and 790, respectively;
(v) SEQ ID NO: 726 and 724, respectively;
(vi) SEQ ID NO: 748 and 746, respectively;
(vii) SEQ ID NO: 770 and 768, respectively; and
(viii) SEQ ID NO: 792 and 790, respectively.

* * * * *